United States Patent 11,098,302 (IDENTIFICATION OF POLYNUCLEOTIDES ASSOCIATED WITH A SAMPLE) - sequence listing, part 130

SEQ ID NO: 459650 - DNA, 435 bp, Homo sapiens; identical to SEQ ID NO: 447770
  misc_feature: HEFZJCU01C4EWF.40.27.C05.1.454.heavy.3.raw

SEQ ID NO: 459651 - DNA, 525 bp, Homo sapiens
  misc_feature: HEFZJCU01CY1NA.9.37.D04.1.454.heavy.3.raw
tgatacgtctcacgaccggtgctcgatttagtagcatactgttgggtttgggggagccctggtacagccgggggggtccctgacactctcctgtacagcctctggattcacctttaacacctatgcattgagctgggtccgccaggccccagggaaggggctggactgggtcgcagccattagtggcaatggcgaaaacacatattacgcagactccgtgaagggccggttcaccatttccagagacaatttcaagaacacgctgtatctgcagatgaacagcctgagagccgaggacacggccgtatatcactgtgccaaagatcagaaggacggttcggggagttacaaatattactacttctactatggaatggacgtctggggccgagggaccacggtcaccgtcgtcctcagcctccaccaagggcccatcggtcttcccctggcaccctcctccaagagcacctctgggggcacagcggccctgggctgcctggtcaaggactacttccagacgtatca

SEQ ID NO: 459652 - DNA, 491 bp, Homo sapiens; identical to SEQ ID NO: 447981
  misc_feature: HEFZJCU01AFOU2.47.85.H08.1.454.heavy.3.raw

SEQ ID NO: 459653 - DNA, 520 bp, Homo sapiens
  misc_feature: HEFZJCU01CJK2R.12.40.D07.1.454.heavy.3.raw
atacgacgtacacgaccggtgctcgatttagtgatagagcgtaacaacagaggactcaccatggagtttgggctgagcgtgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatggggcttgttctgggggccagggacctggtcatcgtctccccagcctccaccaagggcccatcggtcttcccctggcg

SEQ ID NO: 459654 - DNA, 498 bp, Homo sapiens
  misc_feature: HEFZJCU01AYYIY.5.70.G04.1.454.heavy.3.raw
atcagacacgcacgaccggtgctcgatttagtgtagtgtgaagggaaagggggggagaggagccccagccctgagattcccaggtgtttccattcagtgatcagcactgaacacagaggactcaccatggagttgggactgaactggattttccttttggctatgttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtggtgacataggctatgcggactctgtgaagggccgcttcaccatctccagagacaacgccaagaactccctgtatctacaaatgaacagtctgagagttgaggacacggccttctattactgtgcaaagatcgggacgaagtggtggtgg

SEQ ID NO: 459655 - DNA, 505 bp, Homo sapiens
  misc_feature: HEFZJCU01ASDMX.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctattttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccgttcaccctctccagagacacttccaacaacatcttgtatcttcacatgcacaatctgagagtcgacgacacggccacctattattgtgcgcgacatgactacgctcaattctggggccagggacg

SEQ ID NO: 459656 - DNA, 496 bp, Homo sapiens
  misc_feature: HEFZJCU01C43HV.52.30.C08.1.454.heavy.3.raw
cgcagtacgacacgaccggtgctcgatttagtctgacgtcaaagggaaaggggtctgggagacgagcccagcactggaaggcgccggtgtttccattcggtgatcagcactgaacacagaggactcaccatggagtttgggctgagctgggttttcctcgttgctcttttaagaggtgtccagtgttatgtgcagctggtggagtctgggggagcgtggtccagcctggcaggtcactgagactcgcctgtacaccctctggattcaccttcagcaactatgctatgcactgggtccgcctggctcccggcaagggtctggactgggtggcaggtatatcagctgatgggaccaaaaatactacgcaaactccgtgaagggccgattcaccatatcaagagacagttccgatgacacagtctatctgcaatgaacagcctgaaagttgacgacacgggtctttttactgtgcgcctggaagcagtggctggccaca

SEQ ID NO: 459657 - DNA, 398 bp, Homo sapiens; identical to SEQ ID NO: 444524
  misc_feature: HEFZJCU01ELXJV.7.60.F05.1.454.heavy.3.raw

SEQ ID NO: 459658 - DNA, 484 bp, Homo sapiens; identical to SEQ ID NO: 448254
  misc_feature: HEFZJCU01DE2DD.12.75.G09.1.454.heavy.3.raw

SEQ ID NO: 459659 - DNA, 499 bp, Homo sapiens
  misc_feature: HEFZJCU01CS2IX.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagtatttctatagaggtgacgtacgggggcttcg

SEQ ID NO: 459660 - DNA, 513 bp, Homo sapiens; identical to SEQ ID NO: 446699
  misc_feature: HEFZJCU01CSKJ8.12.25.C03.1.454.heavy.3.raw

SEQ ID NO: 459661 - DNA, 538 bp, Homo sapiens
  misc_feature: HEFZJCU01BFLEB.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcaccctcctccaagagcacctctgggggcacagcggccctgggctgcctggtacgagtactacctctacgtacgtctcgtagcggcggtgtcggacgacggccga

SEQ ID NO: 459662 - DNA, 514 bp, Homo sapiens
  misc_feature: HEFZJCU01EGBU1.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggattattagtccctactttgactactggggccagggaactctggtcaccgtctccgcagcctcaccaaggcccatcc

SEQ ID NO: 459663 - DNA, 501 bp, Homo sapiens; identical to SEQ ID NO: 447719
  misc_feature: HEFZJCU01CAJ5B.17.10.A10.1.454.heavy.3.raw

SEQ ID NO: 459664 - DNA, 518 bp, Homo sapiens
  misc_feature: HEFZJCU01BKHSZ.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgagacacggccgtctattattgtggtcatagacctaggatacaacgacggtggtacctggtattc

SEQ ID NO: 459665 - DNA, 499 bp, Homo sapiens; identical to SEQ ID NO: 453198
  misc_feature: HEFZJCU01CR90V.11.71.G05.1.454.heavy.3.raw

SEQ ID NO: 459666 - DNA, 541 bp, Homo sapiens
  misc_feature: HEFZJCU01EO137.13.88.H11.1.454.heavy.3.raw
tcacgtactacacgaccggtgctcgatttagcgacagcgagaacacacaaaggggccgggagaggagccccagccctgggattcccaagtgttttcattcagtgatcaggactgaacacagaggactcaccatggagtttgggctgagctggattttccttggtgtttttttaaaaggtgtccactgtgagctgcagctggtggagtctggggggggcttggtaaagcctggggggtcccttacactctcctgtgtagcctctaaatcactttcaacgacgcctggatgagctgggtccgccaggcgccagggaggggactggagtgggttggccgtattaaagcgaggccgatggtgggacagcagacttcgctgcacccgtgcaagccagattcaccctctcaagacatgatttagagaatactgtgtatttgcaaatgaacagcttgacaaccgaggacgcaggcgtttattactgtgccagtacgttccacctggccactctactttctttgacttcgtcggggccagggaaccctc

SEQ ID NO: 459667 - DNA, 513 bp, Homo sapiens
  misc_feature: HEFZJCU01C82VJ.16.2.A02.1.454.heavy.3.raw
tgtactactccacgaccggtgctcgatttagactcatctacagggggagagaggagccttagccctggattccaaggcctatccacttggtgatcagcactgaccaccgaggattcaccatggagctggggctccgctgggttttccttgttgctattttagaaggtgtccagagtgaggtgcagctggtggagtttgggggaggcctggtcaagcctggggggtccctgagactctcctgtgcagcctctgaattcatcttcagtatctataacatgaactgggtccgccagactccagggaaggggctggagtgggtcgcatccattagtggtggtaataattacatatactacggagactcaatgaagggccgcttcaccatctccagagacaacgccgaaaactcactgtatctgcagatgaacagcctgagagccgaagacacggctgtgtattactgtgcgagaggtcttactatagttcggggagttaatataacgacgtatttcg

SEQ ID NO: 459668 - DNA, 527 bp, Homo sapiens; identical to SEQ ID NO: 450092
  misc_feature: HEFZJCU01ASTL8.18.33.C11.1.454.heavy.3.raw

SEQ ID NO: 459669 - DNA, 518 bp, Homo sapiens; identical to SEQ ID NO: 449255
  misc_feature: HEFZJCU01B0ZEN.3.17.B06.1.454.heavy.3.raw

SEQ ID NO: 459670 - DNA, 510 bp, Homo sapiens; identical to SEQ ID NO: 456738
  misc_feature: HEFZJCU01CVFA6.48.53.E09.1.454.heavy.3.raw

SEQ ID NO: 459671 - DNA, 445 bp, Homo sapiens; identical to SEQ ID NO: 445213
  misc_feature: HEFZJCU01AO20Y.3.86.H09.1.454.heavy.3.raw

SEQ ID NO: 459672 - DNA, 506 bp, Homo sapiens
  misc_feature: HEFZJCU01CNIO7.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgagggccgattcaccatctccagagacgattccaagaacacgttgtatcttcaatgaacagcctgacagtcgacgacacggccatgtatttttgtgcgagcgacccggggctcctcaatggctttcattacg

SEQ ID NO: 459673 - DNA, 409 bp, Homo sapiens; identical to SEQ ID NO: 444519
  misc_feature: HEFZJCU01CKCOF.3.41.D08.1.454.heavy.3.raw

SEQ ID NO: 459674 - DNA, 512 bp, Homo sapiens
  misc_feature: HEFZJCU01BNQ1C.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctgggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctcattccgttcatctgaatactggggccagggaaccctggtcgtccg

SEQ ID NO: 459675 - DNA, 517 bp, Homo sapiens
  misc_feature: HEFZJCU01BC6J2.52.78.H01.1.454.heavy.3.raw
cgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggccgtggcaccctggtcactgtcttctcagcctccaccaagggcccatcggtcttcccctggcaccctcctccaagagcacctctgggggcacagcggccctgggctgcctggtcaaggactactcctatacga

SEQ ID NO: 459676 - DNA, 506 bp, Homo sapiens; identical to SEQ ID NO: 457894
  misc_feature: HEFZJCU01CZE0X.47.55.E11.1.454.heavy.3.raw

SEQ ID NO: 459677 - DNA, 502 bp, Homo sapiens
  misc_feature: HEFZJCU01DKD32.48.34.D01.1.454.heavy.3.raw
agtatacatacacgaccggtgctcgatttagatcgtctgtgttgggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttccccctggcgccctgctccaggagcacctccgagagcacagcggccctgggctgcctggtcaaggactacttcctatgtatact

SEQ ID NO: 459678 - DNA, 501 bp, Homo sapiens; identical to SEQ ID NO: 449500
  misc_feature: HEFZJCU01AV34H.17.25.C03.1.454.heavy.3.raw

SEQ ID NO: 459679 - DNA, 481 bp, Homo sapiens; identical to SEQ ID NO: 446848
  misc_feature: HEFZJCU01D5MYX.11.23.C01.1.454.heavy.3.raw

SEQ ID NO: 459680 - DNA, 506 bp, Homo sapiens; identical to SEQ ID NO: 444696
  misc_feature: HEFZJCU01A6SB9.16.34.D01.1.454.heavy.3.raw

SEQ ID NO: 459681 - DNA, 535 bp, Homo sapiens
  misc_feature: HEFZJCU01CMXFQ.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctgggccaagggacgctggtcaccgtctcttcagcctccaccaagggcccatcggtcttccctggcaccctcctccaagagcacctctgggggcacagcc

SEQ ID NO: 459682 - DNA, 506 bp, Homo sapiens; identical to SEQ ID NO: 444696
  misc_feature: HEFZJCU01C91FW.16.34.D01.1.454.heavy.3.raw

SEQ ID NO: 459683 - DNA, 500 bp, Homo sapiens
  misc_feature: HEFZJCU01EYO8O.49.68.G02.1.454.heavy.3.raw
agtcgagagacacgaccggtgctcgatttagtcgatagtgaagggaaaggggacccaacaaccacatccctcctcagaagcccccagagcacaacgcctcaccatggactggacctggaggatcctctttttggtggcagcagccacaggtgcccactcccaggtccagcttgtgcagtctggggctgaggcgaagaagcctggggcctcagtgaaggtttcctgccaggcttctggatacaccctcagtacccatgctatccattgggtgcgccaggcccccggacaaagacttgagtggatgggatggatcagcgctggcaatggtgacagacactattcacagaagttccagggcagagtcaccatcaccagggacacatccgcgagcacagcctacatggaactgagcagcctgagatctgaagacacgggtgtatattactgtgcgaggaggggaagtggggattattgtagatggcgccaggtgcccgggcccc

SEQ ID NO: 459684 - DNA, 534 bp, Homo sapiens
  misc_feature: HEFZJCU01CNAMA.18.33.C11.1.454.heavy.3.raw
  modified_base (520)..(520): a, c, t, g, unknown or other
tacgagtatgcacgaccggtgctcgatttagagtgagctcgttgggttttccttgttgctatttcaaaaggtgtccagtgtgaggtgcagttggtggagactggaggaggcttgatccagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatcccctgaaagcgtcaactactactactacggtatggacctctgggccaagggaccacggtcaccgtctcctcagcctccaccaagggcccatcggtcttcccctggcgccctgctccaggagcacctccgagagcacngcggccctggctcg

SEQ ID NO: 459685 - DNA, 495 bp, Homo sapiens; identical to SEQ ID NO: 444618
  misc_feature: HEFZJCU01DK8T1.3.26.C04.1.454.heavy.3.raw

SEQ ID NO: 459686 - DNA, 519 bp, Homo sapiens; identical to SEQ ID NO: 446650
  misc_feature: HEFZJCU01CHOTJ.13.76.G10.1.454.heavy.3.raw

SEQ ID NO: 459687 - DNA, 523 bp, Homo sapiens
  misc_feature: HEFZJCU01ER0XN.49.82.H05.1.454.heavy.3.raw
agtcgagagacacgaccggtgctcgatttagtcgagctctctcgcgggcacgaccggtgctcgatttagcgagacgcgcagggggagccccagccctgggattcccagctgtttctgcttgctgatcaggactgcacacagagaactcaccatggagtttgggctgacctgggttttccttgttgctattttaaaaggtgtccagtgtgaagggcagctggtggagtccgggggaggcttggttcagcctggggggtccctaagactctcctgtgcagcctctggaatcgccttcaataagttttggatgtactgggtccgccaagttccagggaaggggctgatgtgggtctcacgtattgatgttgatgggagttacagtgaccacgcggactctgtgaagggccgattcaccgtctccagagaaaacgccaaagaacacggtgtatctgcaaatgactggcctgagagccgaggacacggcagtttattactgtgcaagaggcttgtggtcgactgtccg

SEQ ID NO: 459688 - DNA, 390 bp, Homo sapiens; identical to SEQ ID NO: 447143
  misc_feature: HEFZJCU01B71ON.48.70.G04.1.454.heavy.3.raw

SEQ ID NO: 459689 - DNA, 449 bp, Homo sapiens
  misc_feature: HEFZJCU01EQF6K.53.27.C05.1.454.heavy.3.raw
cgcgtatacacacgaccggtgctcgatttagacgcgatcgaagggtttgggctcggggctgccctttggctttggagatggttttctcgatgggggctggagtgggtggcagttatatcaaatgatggaagtaagaaatactatgtagactccgtgaagggccgattcaccatctccagagacaattccaagaatacgctgtatctgcacatgaacagcctgagagccgaagacacgggtgtttattactgtgcgaacttaattacggaggacaacggtaacccccgtccgcacggtacggacgtctggggccaagggaccacggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 459690 - DNA, 511 bp, Homo sapiens
  misc_feature: HEFZJCU01DMQXY.13.87.H10.1.454.heavy.3.raw
tcacgtactacacgaccggtgctcgatttagcagtactgcgttgggtttgggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgaccaagaactcctgtatctgcaaatgaacagcctgagagctgaggacacggccttgtattattgtgacaaagataccaacccttacgtattttggagtggttac

SEQ ID NO: 459691 - DNA, 394 bp, Homo sapiens
  misc_feature: HEFZJCU01AK6X1.16.68.G02.1.454.heavy.3.raw
tgtactactccacgaccggtgctcgatttagtcgatagtgaagggaagggactggagtggattgcctatatctcttacagtgggagcagcaactacaacccctccctcaagagtcgagtcgacatattagtagacacgtccaagaaccagttttccctgaggctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggccctgggctgcctggtcaaggactacttccgagtgtaca

SEQ ID NO: 459692 - DNA, 519 bp, Homo sapiens
  misc_feature: HEFZJCU01DWUP0.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgtctggggccaggggaccctggtcatcgtctccccagcctccaccaaggcccatcggtcttcccctggcg

SEQ ID NO: 459693 - DNA, 462 bp, Homo sapiens
  misc_feature: HEFZJCU01DW0P6.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggcccatcggtcttcccctggcgccctgctccaggagcacctccgagagcacagcggcctggctgcctgtcaggactactcctacagtg

SEQ ID NO: 459694 - DNA, 515 bp, Homo sapiens
  misc_feature: HEFZJCU01AHO4G.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctgggagtgggtggccaacataaatgacgatgcaaaggagacctactatttggactctgtgaggggccattcatcatctccagagacaacgccgacaactcactgtctctgctgatgagcagcctgagagccgacgacacggctatctattactgtgcgaaactctcattccgttcatctgaatacgtggggccaggggaaccctgggtccgtccg

SEQ ID NO: 459695 - DNA, 490 bp, Homo sapiens; identical to SEQ ID NO: 449137
  misc_feature: HEFZJCU01B1CXX.11.26.C04.1.454.heavy.3.raw

SEQ ID NO: 459696 - DNA, 484 bp, Homo sapiens
  misc_feature: HEFZJCU01BGGOK.8.39.D06.1.454.heavy.3.raw
  modified_base (458)..(458): a, c, t, g, unknown or other
ctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattacngtgcgagaatcgaagaaggtggctac

SEQ ID NO: 459697 - DNA, 518 bp, Homo sapiens
  misc_feature: HEFZJCU01C3WOY.40.9.A09.1.454.heavy.3.raw
tctagcgactcacgaccggtgctcgatttagcgagacgcgcaggggggtctcagagaggagccttagccctggactccaaggcctttccacttggtgatcagcactgagcacagaggactcaccatggaattggggctgagctgggttttccttgttgctattttagaaggtgtccagtgtgcggtgaaactagcggagtctgggggaggcttggtccagcctggggggtccctaagactctcctgcgcagcctctggattcatgtttagtgattattggatggcttgggtccgtcaggctccagggaaagggctggagtttgtggccaagatgaaccacgacggaaatgagaaaaactatgcggactctgtgaagggccgattcaccatttccagagacaacgccaagaagtcactctctctacacatgaccagcctgacagccgaggacacggctgtttattactgtgcgagagatggcactcggggcggtgactttgactactggggccagggcc

SEQ ID NO: 459698 - DNA, 504 bp, Homo sapiens
  misc_feature: HEFZJCU01ANAS5.52.70.G04.1.454.heavy.3.raw
  modified_base (502)..(502): a, c, t, g, unknown or other
cgcagtacgacacgaccggtgctcgatttagtgtagtgtgaagggaaaggggacccaacaaccacatccctcctcagaagcccccagagcacaacgcctcaccatggactggacctggaggatcctctttttggtggcagcagccacaggtgcccactcccaggtccaaattgtgcagtctggggctgaggtgaagaagcctggggcctcagtgaaggtttcctgcaaggcttctggatacagtttcactaggtattcgatgcattggctgcgccaggcccccggacaaaggcctgagtggatgggaagtctcagtgatggcaaaggtgacaaaaagtattcacagaagttccagggcagagtcaccattaccagcgacgcatccgcgaacacagcctatatggaactcagcagcctgagatctgaagacacggctgtctattactgtgcgagggtcggcacgctgacaacctcttacttctattcctacgctatggacgtntc

SEQ ID NO: 459699 - DNA, 499 bp, Homo sapiens; identical to SEQ ID NO: 447792
  misc_feature: HEFZJCU01DGYVE.17.10.A10.1.454.heavy.3.raw

SEQ ID NO: 459700 - DNA, 488 bp, Homo sapiens
  misc_feature: HEFZJCU01B53EB.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctccgagagcacagcggccctgggctgcctggtcaaggctacttcctacgtgagct

SEQ ID NO: 459701 - DNA, 511 bp, Homo sapiens
  misc_feature: HEFZJCU01EMB2S.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttccccctggcgccctgctccaggagcacctctgggggcacagcggccctgggctgcctggtcaaggactacttcccat

SEQ ID NO: 459702 - DNA, 479 bp, Homo sapiens
  misc_feature: HEFZJCU01A46XS.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactgggccagggcaccctggtcaccgtctcttcagcctccaccaagggcccatcggtcttcccctggcgccctgctccaggagcacctccgagagcacagcggccctgggctgcctggtcaaggactacttccagacgtatca

SEQ ID NO: 459703 - DNA, 518 bp, Homo sapiens
  misc_feature: HEFZJCU01BW3YD.13.76.G10.1.454.heavy.3.raw
tcacgtactacacgaccggtgctcgatttagtcactcatacagggggcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccaagggaccacggtcaccg

SEQ ID NO: 459704 - DNA, 526 bp, Homo sapiens
  misc_feature: HEFZJCU01ELP61.48.5.A05.1.454.heavy.3.raw
agtatacatacacgaccggtgctcgatttagatagatagacagggggagagaggagcccagccctgggattttcaggtgttttcatttggtgatcaggactgaacagagagaactcaccatggagtttgggttgagctggctttttcttgtggctattttaaaaggtgtccagtgtgaggtgcagctgttggagtctgggggaggcttggtacagccgggggggtccctgagactctcctgtgcaacctctggattcacctttaggggctatgccatgaactgggtccgccaggttcctgggaaggggctggagtgggtctcatctattagtgagactggtgatactacagactacgcagactccgtgaggggccggttcaccgtctccagagacaattccaagaacacgctatttctgcaaatgaacagcctgagagtcgacgacacggccgtatactactgtgcgagacagatgctgccgcctgttccgtggggccagggaaccctggtcaccgtctcctcacg

SEQ ID NO: 459705 - DNA, 533 bp, Homo sapiens
  misc_feature: HEFZJCU01BCG6B.17.28.C06.1.454.heavy.3.raw
  modified_base (520)..(520): a, c, t, g, unknown or other
cgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggtccgtttcaccatctccagagacaacgccaagaattcactgtatctacaactgaacagcctgagagtcgcagacacggccgtgtattactgtgcgagatgtggaaaagtaatggctgtgtttatggggccaggggacnccctggtcaccgt

SEQ ID NO: 459706 - DNA, 517 bp, Homo sapiens
  misc_feature: HEFZJCU01EF0BK.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcgggagttattagtccctactttgactactggggccagggaactctggtcaccgtctccgcagcctccaccaggggccccatcc

SEQ ID NO: 459707 - DNA, 519 bp, Homo sapiens; identical to SEQ ID NO: 445330
  misc_feature: HEFZJCU01B11VV.7.78.H01.1.454.heavy.3.raw

SEQ ID NO: 459708 - DNA, 531 bp, Homo sapiens
  misc_feature: HEFZJCU01EOALC.40.9.A09.1.454.heavy.3.raw
tctagcgactcacgaccggtgctcgatttagcgagacgcgcagggacagaggactcaccatggaattggggctgagctgggttttccttgttgctattttagaaggtgtccagtgtgcggtgaaactagcggagtctgggggaggcttggtccagcctggggggtccctaagactctcctgcgcagcctctggattcatgtttagtgattattggatggcttgggtccgtcaggctccagggaaagggctggagtttgtggccaagatgaaccacgacggaaatgagaaaaactatgcggactctgtgaagggccgattcaccatttccagagacaacgccaagaagtcactctctctacacatgaccagcctgacagccgaggacacggctgtttattactgtgcgagagatggcactcgggcgggtgactttgactactgggccagggcgaccctggtcaccgtctcctcagcctccaccaacggggcccgactcggtcttccccctcggccgccctcgcaggagcacc

SEQ ID NO: 459709 - DNA, 508 bp, Homo sapiens
  misc_feature: HEFZJCU01D3V3D.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaaactcctactacggtctggacgtctggggcc

SEQ ID NO: 459710 - DNA, 482 bp, Homo sapiens; identical to SEQ ID NO: 451792
  misc_feature: HEFZJCU01EQ1YN.19.71.G05.1.454.heavy.3.raw

SEQ ID NO: 459711 - DNA, 527 bp, Homo sapiens
  misc_feature: HEFZJCU01BZSRY.12.40.D07.1.454.heavy.3.raw
atacgacgtacacgaccggtgctcgatttagtgatagagcgtaacaacagagggctcaccatggagtttgggctgagcgtgggttttccgtcgttagctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatggggcttgttctggggccaggggaccctggtcatcgtctcccagcctccaccaaggcccatcggtcttccccctggcgcctcg

SEQ ID NO: 459712 - DNA, 384 bp, Homo sapiens; identical to SEQ ID NO: 444454
  misc_feature: HEFZJCU01AHEDP.11.61.F06.1.454.heavy.3.raw

SEQ ID NO: 459713 - DNA, 493 bp, Homo sapiens
  misc_feature: HEFZJCU01DNHKL.40.33.C11.1.454.heavy.3.raw
tctagcgactcacgaccggtgctcgatttagagtgagctcgttgggtttggggaggcttagttcagcctggggggtccctgagactctcctgtgcagcctctggagtcactctctccgcctactgggtactctgggtccgccaagctccagggaaggggctggagtgggtcgcacgtatttataaagatggatccacagcgtacgcggactccgtgaagggccgattcaccatctccagagacaacgccaagaacacagtgtctctgcaaatggacagtctgagagccgaggacacgggtgtctattattgtacaaaagtggggactaatgaatatggtgtggacgtctggggccaagggaccacggtcgtcgcctcttatgcctccaccaagggcccatcggtcttccccctggcgccctgctccaggagcacctccgagagcacagcggccctggggctgcctggtcgaaggactacttccagtcgctaga

SEQ ID NO: 459714 - DNA, 496 bp, Homo sapiens
  misc_feature: HEFZJCU01CVS40.16.37.D04.1.454.heavy.3.raw
tgtactactccacgaccggtgctcgatttagtagcatactgtgggtttgggggagacttagtacagccggggggtccctgagactctcctgtgcagcctctggattcacctttagtgcctatgccatgagctgggtacgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccaagagcacctctgggggcacgagcggccctgggctgcctggtcaaggactacttccgagtagtaca

SEQ ID NO: 459715 - DNA, 544 bp, Homo sapiens
  misc_feature: HEFZJCU01CBJK1.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacgacgggcgtttattactgtgcgagagggacggactacggtgactacgtgggggtttccgaccccgtgggggcccgaggggaaccccgtggtccacccgtctccctcacgccctccaacccg

SEQ ID NO: 459716 - DNA, 497 bp, Homo sapiens
  misc_feature: HEFZJCU01CW99P.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtctttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctgggccaaggtacagcggtcaccgtcgcctcagcctccaccaagggcccatcggtcttcccctggcaccctctccaag

SEQ ID NO: 459717 - DNA, 506 bp, Homo sapiens; identical to SEQ ID NO: 445682
  misc_feature: HEFZJCU01ELIZQ.48.44.D11.1.454.heavy.3.raw

SEQ ID NO: 459718 - DNA, 535 bp, Homo sapiens
  misc_feature: HEFZJCU01ERAVR.12.12.B01.1.454.heavy.3.raw
atacgacgtacacgaccggtgctcgatttagtagtgtagattccgcgggggctttctgagagtcatggacctcctgtgcaggaacatgaagcacctgtggtttttcctcctgctggtggcagctcccagatggggcctgtcccaggtgcagctgcaggagtcgggcccaggactggtgaagccttcggagaccctgtccctcacctgcgctgtgtccggtttctccatcagtagtgggcattattggggctggatccggcagcccccagggaaggggctggagtggattgggagtatctattttagcgggagcacctaccagaacgcgtccctcaagagtcgaatcaccatgtcggtggacacatcgaagaaccagatctcccttaagttgaggtctgtgaccgccgctgacacggccgtctattactgtgcgagagtccgtgctggaagaacacttttttgacttattggggccagggaaatccgtggtcaccgtcgcctcacgcctccaccaagggcccatcggtcttccccg

SEQ ID NO: 459719 - DNA, 502 bp, Homo sapiens
  misc_feature: HEFZJCU01BORNS.13.33.C11.1.454.heavy.3.raw
tcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaataagaattgcaacgatgcttttgatatgtggggccaagggacacg

SEQ ID NO: 459720 - DNA, 513 bp, Homo sapiens
  misc_feature: HEFZJCU01D7DD8.19.26.C04.1.454.heavy.3.raw
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctggggccaagggaccacggtcatcgtctccccagcctccaccaagggcccatcggtcttcccctggcgcctgctccaggagcaccg

SEQ ID NO: 459721 - DNA, 528 bp, Homo sapiens; identical to SEQ ID NO: 445587
  misc_feature: HEFZJCU01DHWFT.7.70.G04.1.454.heavy.3.raw

SEQ ID NO: 459722 - DNA, 523 bp, Homo sapiens
  misc_feature: HEFZJCU01EQ5WC.14.55.E11.1.454.heavy.3.raw
cgtctagtaccacgaccggtgctcgatttagcactcgcacgttgggtttggggggaagaggaagactgacggtccccccaggagttcaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgtattactgtgtcagagatggaggggtggtgatccaggtatgattgtgtactactaccacggtctggacgtctggggccaagggaccacggtcaccgtctcctcagcctccaccaaggccatcgtcttcccctggcaccctcctccaagagcacctctgggggcacagcggccctgggctgcctggtcaaggactacttaccg

SEQ ID NO: 459723 - DNA, 521 bp, Homo sapiens; identical to SEQ ID NO: 445317
  misc_feature: HEFZJCU01ECXJX.12.40.D07.1.454.heavy.3.raw

SEQ ID NO: 459724 - DNA, 513 bp, Homo sapiens
  misc_feature: HEFZJCU01AQZDA.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctgctccagagcacctctggggcacagcggcccg

SEQ ID NO: 459725 - DNA, 494 bp, Homo sapiens
  misc_feature: HEFZJCU01ADAW6.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaagtgacgtggtattccggggggac

SEQ ID NO: 459726 - DNA, 400 bp, Homo sapiens; identical to SEQ ID NO: 444452
  misc_feature: HEFZJCU01AF6YR.47.24.C02.1.454.heavy.3.raw

SEQ ID NO: 459727 - DNA, 503 bp, Homo sapiens; identical to SEQ ID NO: 445995
  misc_feature: HEFZJCU01ECNVW.17.25.C03.1.454.heavy.3.raw

SEQ ID NO: 459728 - DNA, 519 bp, Homo sapiens
  misc_feature: HEFZJCU01C7Q3N.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaaggcccatcggtctcccctggcg

SEQ ID NO: 459729 - DNA, 499 bp, Homo sapiens
  misc_feature: HEFZJCU01DCPRK.17.10.A10.1.454.heavy.3.raw
cgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaatttgataggctctatggactggacttct

SEQ ID NO: 459730 - DNA, 529 bp, Homo sapiens
  misc_feature: HEFZJCU01B8QOZ.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgacagcctgtcatctgaggacacgggcttctacttctgtgcgaggagtaattactataacactgctcctttttacacctcccttgacttctggggccatggaaccccggtccg

SEQ ID NO: 459731 - DNA, 515 bp, Homo sapiens
  misc_feature: HEFZJCU01CWUR3.52.78.H01.1.454.heavy.3.raw
cgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggttgttgtcgttgcaccagctgccctaccggctgctacttcgatctctggggccgtggcaccctggtcactgtcttctcagcctccaccaagggcccatcggtcttcccctggcaccctcctccaagagcacctctgggggcacagcggccctgggctgcctggtcaaggactactcctatacg

SEQ ID NO: 459732 - DNA, 487 bp, Homo sapiens
  misc_feature: HEFZJCU01COOIG.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaaggcccatcggtcttcccctggcgcctgctccaggagcacctccgagagcacagcggccctgggctgcctggtcaaggactacttcctacgtgagct

SEQ ID NO: 459733 - DNA, 516 bp, Homo sapiens
  misc_feature: HEFZJCU01A3QJN.48.78.H01.1.454.heavy.3.raw
agtatacatacacgaccggtgctcgatttagtgtgagtagtttgggtttggggacccaacaaccacacccctcctaagaagaagcccctagaccacagctccacaccatggactggacctggaggatcctcttcttggtggcagcagcaacaggtgcccactcccaggtgcagttggtgcaatctgggtctgatttgaagaagcctggggcctcagtgaaggtttcctgcagggcttctggatactccttcactgactatggtatcaattgggtgcgacaggcccctggccaagggcttgagtggatggggtggatcgacaccaacactgggaacccaacacatgcccggggcttcaaaggacggtttgacttctccttggccacctctgtcagcacggcatatctgcagatcagcagcctaaagcctgaggacactgccgtgttttattgtgcgagattccaggcgagggaggataccgattcttatattagcgactactactacttcggaatgg

SEQ ID NO: 459734 - DNA, 483 bp, Homo sapiens; identical to SEQ ID NO: 447485
  misc_feature: HEFZJCU01EEUGN.40.71.G05.1.454.heavy.3.raw

SEQ ID NO: 459735 - DNA, 488 bp, Homo sapiens; identical to SEQ ID NO: 444617
  misc_feature: HEFZJCU01B6A9P.4.6.A06.1.454.heavy.3.raw

SEQ ID NO: 459736 - DNA, 503 bp, Homo sapiens; identical to SEQ ID NO: 444557
  misc_feature: HEFZJCU01AXURS.9.33.C11.1.454.heavy.3.raw

SEQ ID NO: 459737 - DNA, 437 bp, Homo sapiens; identical to SEQ ID NO: 444603
  misc_feature: HEFZJCU01AM7QQ.3.21.B10.1.454.heavy.3.raw

SEQ ID NO: 459738 - DNA, 478 bp, Homo sapiens
  misc_feature: HEFZJCU01CSEJB.51.80.H03.1.454.heavy.3.raw
cgatcgtatacacgaccggtgctcgatttagctgtgcgtcgaagggaaagggggcagagcctgctgaattctggctgaccagggcagtcaccagagctccagacaatgtctgtctccttcctcatcttcctgcccgtgctgggcctcccatggggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagttgctgggaaggacatactacaggtccaagtggtttaatgattatgcagtatctgtgaaaagtcgaataaccatcaaccagacacatccaagaaccagttctccctgcaactgaactctgtgactcccgaggacacggccgtgtattactgtgcaagaggttggttaac

SEQ ID NO: 459739 - DNA, 400 bp, Homo sapiens; identical to SEQ ID NO: 444452
  misc_feature: HEFZJCU01DXNPY.47.24.C02.1.454.heavy.3.raw

SEQ ID NO: 459740 - DNA, 509 bp, Homo sapiens; identical to SEQ ID NO: 444586
  misc_feature: HEFZJCU01DLIO0.12.78.H01.1.454.heavy.3.raw

SEQ ID NO: 459741 - DNA, 536 bp, Homo sapiens
  misc_feature: HEFZJCU01DKWJU.52.49.E05.1.454.heavy.3.raw
cgcagtacgacacgaccggtgctcgatttagagcgactagcaacacacaaaggggacccaaaaaccacacccctccttgggagaatcccctagatcacagctcctcaccatggcctggacctggagcatccttttcttggtggcagcagcaacaggtgcccactcccaggttcacctggtgcagtcgggaggtgaggttaagaggcctggggcctcagtgaaggtcgcctgcaaggcttcaggttacaccctttccacgtctggtatcagttgggtgcgacaggcccccggacaagggcttgagtggatgggatggatcagcggtgacaacggcaacacaaattatggacagaagttccagggcagagtcaccatgaccgcggacacatccacgaacacagcctacatggagctgaggagcctaagatctgacgacacggccgtttattactgtgtgagagattttagggacctcggccttgggggagttatcgttactttgactactggggccagggaacccaggtcaccggtct

SEQ ID NO: 459742 - DNA, 504 bp, Homo sapiens
  misc_feature: HEFZJCU01CUPNK.53.54.E10.1.454.heavy.3.raw
cgcgtatacacacgaccggtgctcgatttagatcgtagcagaacacacaaaggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtccgggggaggcgtggtccagcctgggaggtccctgagactctcctgtgtagcctctggattcaccttcagggtctatggcatgaactgggtccgccagactccaggcaaggggctggagtgggtggcatttatatcatttgatggcactaataaatactatgcagactccgtgaggggccgattcaccatctccagagacaattccaagaacatggtgtttctgcaaatgaacagcctgagagttgaagacacggctgtgtattactgtgcgaaacggaatgagtgggaactagggg

SEQ ID NO: 459743 - DNA, 521 bp, Homo sapiens; identical to SEQ ID NO: 445317
  misc_feature: HEFZJCU01CK689.12.40.D07.1.454.heavy.3.raw

SEQ ID NO: 459744 - DNA, 319 bp, Homo sapiens
  misc_feature: HEFZJCU01CTLZZ.14.28.C06.1.454.heavy.3.raw
cgtctagtaccacgaccggtgctcgatttagagctcacgtattgggtttgggtgccgaagttgctggaggtcacggtcaccacgctgctgaggtctgtgaccgctgcggacacggccctttattactgtgcgcgagggcccctatcgagtgactatgatcccaggccctttgactcctgggccagggaaccctggtcaccgtctcctcagcctccaccaagggcccatcggtcttccccctggcgccctgctccaggagcacctccgagagcacagcggccctgggctgcctggtcaaggactacttccgtactagacg

SEQ ID NO: 459745 - DNA, 509 bp, Homo sapiens
  misc_feature: HEFZJCU01A6O72.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctgggagtgggtggccaacataaatgacgatgcaaaggagacctactatttggactctgtgaggggccattcatcatctccagagacaacgccgacaactcactgtctctgctgatgagcagcctgagagccgacgacacggctatctattactgtgcgaaactctcattccgttcatctgaatactgggccagggaaccctggtcgccg

SEQ ID NO: 459746 - DNA, 520 bp, Homo sapiens
  misc_feature: HEFZJCU01CY8C8.48.10.A10.1.454.heavy.3.raw
agtatacatacacgaccggtgctcgatttagcgtcgatctcagggcacgaccggtgctcgatttagtagcatactgttgggtttgggggactcctgtgccccaccatggacacactttgctccacgctcctgctgctgaccatcccttcatgggtcttgtcccagatcaccttgaaggagtctgggccaacgctggtgaacccacacagaccctcacgctgacctgcaccttctctgggttctcactcaccactgatgaggtgggtgtggcctggatccgtcagcccccgggaaaggccccggagtggcttggattgatttatggggatggtgacaagcgttacagtgcatctctgaagaccagactctccatcaccaaggacacctccaagaacgaggttgtcctttccttggccaacatgcacccctgtggacacggccacttatttttgtactacacacccatcttgacgactggggatgcttttcatttctggggccaggggaccgtggtcgccgt

SEQ ID NO: 459747 - DNA, 507 bp, Homo sapiens
  misc_feature: HEFZJCU01E0VY1.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgtttctgcaaatgaacagcctgagaattgaggactcgggtatatactactgtgcccgtgacccctgactgataaaccggactaggttcgaccccgtcgggaccgacgggaacccgtggtcaccgtctcctcg

SEQ ID NO: 459748 - DNA, 489 bp, Homo sapiens
  misc_feature: HEFZJCU01DGIHA.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctggtcaaggactacttccgtatctct

SEQ ID NO: 459749 - DNA, 502 bp, Homo sapiens; identical to SEQ ID NO: 450016
  misc_feature: HEFZJCU01B6J22.17.10.A10.1.454.heavy.3.raw

SEQ ID NO: 459750 - DNA, 513 bp, Homo sapiens; identical to SEQ ID NO: 446452
  misc_feature: HEFZJCU01BBPG3.17.33.C11.1.454.heavy.3.raw

SEQ ID NO: 459751 - DNA, 506 bp, Homo sapiens
  misc_feature: HEFZJCU01AGNEW.52.38.D05.1.454.heavy.3.raw
cgcagtacgacacgaccggtgctcgatttagtatctgatagttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttcccctggcaccctcctccaagagcacctctgggggcacagcggccctgggctgcctggtcaaggactacttcctatacgatcg

SEQ ID NO: 459752 - DNA, 512 bp, Homo sapiens
  misc_feature: HEFZJCU01AOX6V.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactactggggcctgggaactctggtcacgtct

SEQ ID NO: 459753 - DNA, 525 bp, Homo sapiens
  misc_feature: HEFZJCU01EW0GP.9.31.C09.1.454.heavy.3.raw
tgatacgtctcacgaccggtgctcgatttagacgtctcatcaaggaaggaagggggggagaggagccccagccttgggattcccaagtgttttcattcagtgatcaggactgaacacagaggactcaccatggagtttgggctgagctggattttccttgctgctattttaaaaggtgtccagtgtgaggtgcaactggtggagtctgggggaggctcggtcaagcctggggagtcccttagactctcctgtgcaacctctggattcaatttcgacatcgcctggatgagttgggcccgccaggctccagggaaggggctggagtgggttggacgtcttaaaagcaagggtagcggtgggacagcagactacgcttcatccgtgaagggcagattcagcatttccagagacgatgcaagacagatgatgtatttacagatgaacagacctaaaaatcggaagacacagccctatatttctgcgtcttcatttcgcagtgggagctccggtttacggtcggtgtac

SEQ ID NO: 459754 - DNA, 497 bp, Homo sapiens; identical to SEQ ID NO: 456695
  misc_feature: HEFZJCU01BVDXL.13.33.C11.1.454.heavy.3.raw

SEQ ID NO: 459755 - DNA, 521 bp, Homo sapiens
  misc_feature: HEFZJCU01ELZD8.4.57.F02.1.454.heavy.3.raw
agcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgtaccagtggggccagggaaccctggtcaccgtctcctcagcttccaccaagggcccatcggtcttccccctcggcgccctcgctccaggacgcacctctcgggggcacgagcc

SEQ ID NO: 459756 - DNA, 528 bp, Homo sapiens; identical to SEQ ID NO: 445974
  misc_feature: HEFZJCU01C4AEQ.12.39.D06.1.454.heavy.3.raw

SEQ ID NO: 459757 - DNA, 501 bp, Homo sapiens
  misc_feature: HEFZJCU01DCN55.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccgattcaccatctccagagacgattccaagaacacgttgtatcttcaaatgaacagcctgacagtcgacgacacggccatgtatttttgtgcgagcgacccggggctcctcaatggctttc

SEQ ID NO: 459758 - DNA, 396 bp, Homo sapiens
  misc_feature: HEFZJCU01BQ92O.47.59.F04.1.454.heavy.3.raw
agctcacgtacacgaccggtgctcgatttagtacacacacttagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccaggggatccctggtcgccgtcggctcagcctccaccaagggcccatcggtcttcccctggcgccctgctccaggagcacctccgagagcacagcggccctgggctgcctggtcaaggactacttcctacgtgagct

SEQ ID NO: 459759 - DNA, 386 bp, Homo sapiens; identical to SEQ ID NO: 446054
  misc_feature: HEFZJCU01B85I4.18.60.F05.1.454.heavy.3.raw

SEQ ID NO: 459760 - DNA, 391 bp, Homo sapiens; identical to SEQ ID NO: 459034
  misc_feature: HEFZJCU01DFL2T.51.72.G06.1.454.heavy.3.raw

SEQ ID NO: 459761 - DNA, 534 bp, Homo sapiens
  misc_feature: HEFZJCU01DHT59.53.68.G02.1.454.heavy.3.raw
cgcgtatacacacgaccggtgctcgatttagtcgatagtgaagggaaaggggcacaagaacatgaaacacctgtggttcttcctcctcctggtggcagctcccagatgggtcctgtcccaggtgcagctgcagcagtgggctcaggactgttgaagccttcggagaccctgtccctcacgtgcgctgtctatggtgggtcattcagtgattattattggacctggatccgccaggccccagggaaggggctggagtggatagcggaaatcaatcatagtggaaagactacctacaacccgtccctcaagagtcgagtcaccttatcggtagacacgcccaagaagcagttctccctgagggtgacgtctgtgaccgccgcggacacggctgtctattactgtgcgagaggccccttagtttcggttttggactggttctcccatggaatccctactttgagtactggggccgcggagccctggtcaccgtctcctcagcctccaccaaggcccatcggtctcccctggcaccct

SEQ ID NO: 459762 - DNA, 524 bp, Homo sapiens
  misc_feature: HEFZJCU01BSAFN.48.4.A04.1.454.heavy.3.raw
agtatacatacacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttctccctgaaactgaccgctgtgaccgccgcggacacggctgtgtattactgtgcgagacgaatgggcgggtggctacgacttgacttttggggccagggaaacctggtcaccgtctcccagcttccaccaagggcccatcggtcttccccg

SEQ ID NO: 459763 - DNA, 519 bp, Homo sapiens
  misc_feature: HEFZJCU01EQWJV.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaacacgctgtatctgcaaatgaacggcctgagagccgaggacacggccgtatattactgtgcccgagggaggttttactatgatattactggttacaaaaagggtactactttgactactggggccagggaaccctggtcaccgtctcctcagcctccaccaacgggcccatcggtcttcccctcggcgccctgctccaggagcacctccgagaacacagcggccctgggctgcctggtcaaggactacttccgagtagtaca

SEQ ID NO: 459764 - DNA, 517 bp, Homo sapiens
  misc_feature: HEFZJCU01A0J0K.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttccccctggccgccctgctccaggagcacctccgagagcacagcggccctgggctcg

SEQ ID NO: 459765 - DNA, 498 bp, Homo sapiens
  misc_feature: HEFZJCU01D7E0O.51.78.H01.1.454.heavy.3.raw
cgatcgtatacacgaccggtgctcgatttagtgtgagtagtttgggtttgggggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttcccctcggcaccctcctccaagagcacctctgggggcacagcggccctgggctgcctggtcaaggactacttcctcgtagcact

SEQ ID NO: 459766 - DNA, 519 bp, Homo sapiens
  misc_feature: HEFZJCU01EVW4Y.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgatttcagagaactcactttatctgcaaatgaacagcctgagaaccgacgacacggccgtctattattgtgtcatagacctaggatacaacgacggtggtacctggtattc

SEQ ID NO: 459767 - DNA, 530 bp, Homo sapiens
  misc_feature: HEFZJCU01E1C6E.51.38.D05.1.454.heavy.3.raw
cgatcgtatacacgaccggtgctcgatttagtatctgatagttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtctgggccaagggaccacggtcaccgtctccttagcctccaccaagggcccatcggtcttcccctcggcaccctcctccaagagcacctc

SEQ ID NO: 459768 - DNA, 385 bp, Homo sapiens
  misc_feature: HEFZJCU01BCDHA.18.60.F05.1.454.heavy.3.raw
tacgagtatgcacgaccggtgctcgatttagtacgtcatcagggaaaggggctggaatatattgggattacctcttacagtgggaccacccattacaacccgtccctcaaaagtcgactcaccatttccgtggacacgtcgaaaacgagttctccctggacttgacctctgtgaccgccgcagacacggctgtttattactgtgcgagacgactacctgactccaatccatactttgactattggggccggggagccctggtcaccgtctcctcagcctccaccaagggcccatcggtcttccccctggcgccctgctccaggagcacctctgggggcacagcggccctgggctgcctggtcaaggactacttcccatactcgta

SEQ ID NO: 459769 - DNA, 539 bp, Homo sapiens
  misc_feature: HEFZJCU01DXAAJ.13.6.A06.1.454.heavy.3.raw
tcacgtactacacgaccggtgctcgatttagatctactgacagggtctccgaaggcttcaccagtcctgtcccaggtgcagctgcgggagtcgggcccaggactggtgaagccttcggagaccctgtccctcacctgcactgtctctggtggctccatcagtagttactactggagctggatccggcagcccccagggaagggactggagtggattgggcatatcttttacagtgggagcaccaactacaacccctccctcaagagtcgagtcaccatatcagtggacacgtccaagaaccagttctccctgaagctgagctctgtgaccgctgcggacacggccgtgtattactgtgcgagctggggttcagggtactttgactactggggccagggaaccctggtcaccgtctcctcacgcctccaccaacgggcccatccggtccttcccccgtggccaccctccctccaacgagcacctcgtgggggcacagcggccctgggctgcctggtcaggactactcctagtacgtgtac

SEQ ID NO: 459770 - DNA, 436 bp, Homo sapiens
  misc_feature: HEFZJCU01EAT0Q.40.27.C05.1.454.heavy.3.raw
tctagcgactcacgaccggtgctcgatttagacgcgatcgaagggtttggggctgggtccgccggcccccagggaaggggctggagtggattgcgagcatatattatgatgagagcgccctctacaaccccccccctctacaacccctccctcaagagtcgggtcaccatatctatagacacgtccaacagtcaattctccctggacttgacctctgtgaccgccgcagacacggctgtatattcctgtgcgacccacggaggggatggcccaaatctgcctactttgaccactggggccagggaaccttggtcaccgtctcctcagcctccaccaagggcccatcggtcttccccctggcgccctgctccaggagcacctccgagagcacagcggccctgggctgcctggtcaaggactacttccagtcgctaga

SEQ ID NO: 459771 - DNA, 506 bp, Homo sapiens
  misc_feature: HEFZJCU01A4LIG.13.67.G01.1.454.heavy.3.raw
tcacgtactacacgaccggtgctcgatttagagtatacatattgggtttgggggggagaggagccccagccctgagattcccacgtgttgccattcggtgatcagcgctgaacacagaggactcgccatggagtttgggctgagctgggttttccttgttgctattttaaaaggtgtccagtgtgaggtgcagctggtagagtctgggggaggtgtggtacggcctggggggtccctcagactctcctgtgcaacctctggattcagatttgatgagtatggcatacactgggtccgccaacctccagggaagggctgcagtggtctctggtataaactggaatggtgccagcacaacttatgcagactctgtgaagggccgattcaccatcctccagagacagtgccgagaactccgtacatctgcaaatgaaacagtctcggagtcgaggacacggccttgtatttctgtgcgaggttagcagtggctggtacttacgcaatgg

SEQ ID NO: 459772 - DNA, 513 bp, Homo sapiens; identical to SEQ ID NO: 446452
  misc_feature: HEFZJCU01DQZZX.17.33.C11.1.454.heavy.3.raw

SEQ ID NO: 459773 - DNA, 530 bp, Homo sapiens
  misc_feature: HEFZJCU01EVINQ.7.78.H01.1.454.heavy.3.raw
  modified_base (387)..(387): a, c, t, g, unknown or other
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcgtttgtcttctccatggatacctntgtcgggacggcttatctgcagataaccaaccttcaacctgacgacactgccgtttattttgtacgagagcgtcgtctgtcagtggaattgactactggggccagggaaccctggtcaccgtctcctcagcctccaccaaggg

SEQ ID NO: 459774 - DNA, 508 bp, Homo sapiens
  misc_feature: HEFZJCU01D8MF5.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgactacacggccgtatatttctgcgcgagagacgtaaagtgacgtggtagttccggggggacgacatgactaccg

SEQ ID NO: 459775 - DNA, 529 bp, Homo sapiens
  misc_feature: HEFZJCU01EWON3.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagccctccaccaagggcccatcggtcttcccctggccgccctcg

SEQ ID NO: 459776 - DNA, 485 bp, Homo sapiens
  misc_feature: HEFZJCU01AXYLI.47.85.H08.1.454.heavy.3.raw
agctcacgtacacgaccggtgctcgatttagtatcactcagtcggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctgggtcatcgtctcctcagcctccaccaagggcccatcggtcttcccctggcgccctgctccaggagcacctccgagagcacagcggccctgggctgcctggtcagactactcctacgtgagct

SEQ ID NO: 459777 - DNA, 507 bp, Homo sapiens
  misc_feature: HEFZJCU01DTQIP.11.6.A06.1.454.heavy.3.raw
cgagagataccacgaccggtgctcgatttagatctactgacagggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtctgggggaggcttggtaaagccgggggggtcccttagactctcctgtgcagcctctggcatcactttcagtgacgcctggatgagctgggtccgccaggctccagggaaggggctggagtgggttggccgtattaaaagcgaggctgctggtgggacaacagactacgctgcacccgtgaagggcagattcaccatctccagagatgattcaaggagcacagtgtttctacaaatgaacagcctgactgccggggacactgccgtgtattactgtgccagcagcagcacctggccactatatttcttttcg

SEQ ID NO: 459778 - DNA, 513 bp, Homo sapiens
  misc_feature: HEFZJCU01EBB5U.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgatgacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggcg

SEQ ID NO: 459779 - DNA, 396 bp, Homo sapiens
  misc_feature: HEFZJCU01EHFZQ.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctatgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 459780 - DNA, 520 bp, Homo sapiens
  misc_feature: HEFZJCU01ECQM9.3.17.B06.1.454.heavy.3.raw
agacgcactccacgaccggtgctcgatttagtcgatagtgaaggggagctctgagagcggagccccagccccagaattcccaggtgttttcatttggtgatcagcactgaacacaaaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaagggctggagtgggttggccgttctagagacacaactaacagtgacaccgcacaatacgccgcgtctgtgaaaggcagattcaccatctcaagagatgattcagagaactcactttatctgcaaatgaacagcctgacgaaccgacgacacggcctctattattgtgtcatacgacctaggataacaacggacggtaggtaccg

SEQ ID NO: 459781 - DNA, 515 bp, Homo sapiens; identical to SEQ ID NO: 448327
  misc_feature: HEFZJCU01AT85Q.13.21.B10.1.454.heavy.3.raw

SEQ ID NO: 459782 - DNA, 506 bp, Homo sapiens
  misc_feature: HEFZJCU01CA6L0.13.39.D06.1.454.heavy.3.raw
tcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactggagtggattgggcttatcaatgccagtggggcaccagctacaaccctcctcaagagccgcgtcaccatttcagtagacacgtccaagaaccagctctccctgaagctgagttctgtgaccgccgcagacacggccgtgtattactgtgcgcgacaggtggacgtctggggccaagggaccacggtcaccgtctcctcagcctccaccaagggcccatcc

SEQ ID NO: 459783 - DNA, 510 bp, Homo sapiens
  misc_feature: HEFZJCU01EF14Z.12.1.A01.1.454.heavy.3.raw
atacgacgtacacgaccggtgctcgatttagacgtctcatcagggggggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagtagtagttattactactggggctggatccgccagcccccaggggaggggctgaagtggattgggagtgtctattatagtgggatcacctactacaacccgtccctcaagagtcgagtcaccatatccgtcgacacgtccaagaaccagttctccctgaagctgagctctgtgaccgccgcagacacggctgtgtattactgtgcgagacagccaagacagattttggagtggttactgttggactactttgactactggggccagggaaccctggt

SEQ ID NO: 459784 - DNA, 525 bp, Homo sapiens
  misc_feature: HEFZJCU01CKT7Y.16.9.A09.1.454.heavy.3.raw
tgtactactccacgaccggtgctcgatttagcgagacgcgcagggggagagaggggcccagccctgggattttcaggtgttttcatttggtgatcaggactgaacagagagaactcaccatggagtttgggctgagctggctttttcttgtggctattttaaaaggtgtccagtgtgaggtgcagttggtggactctgggggagacctgataccgcctggggggtccctgagactctcctgtacagcctctggattcacctttaggagccatgccatgagctgggtccgccaggctccagggaaggggctggagtgggtctctactattactgctagtggtaatcatgcatactatgcagactccgtgaagggccggttcaccttcaccagagacaattccaagaacacgctctatctgcaattgaccagcctgagcgccgaggacacggccatgtattactgtactaaatcgcgggtggccgcggccggtacctcggatggttttgatttctggggccaaggga

SEQ ID NO: 459785 - DNA, 532 bp, Homo sapiens
  misc_feature: HEFZJCU01B5D5R.18.59.F04.1.454.heavy.3.raw
tacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaccaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatcccctgaaacgcgtcaactactactactacggtatggacctcg

SEQ ID NO: 459786 - DNA, 515 bp, Homo sapiens
  misc_feature: HEFZJCU01CLCAW.16.87.H10.1.454.heavy.3.raw
tgtactactccacgaccggtgctcgatttagcagtactgcgttgggtttgggggagccccagccctgggattcccagctgtttctgcttgctgatcaggactgcacacagagaactcaccatggagtttgggctgatctgggtcttccttgttgctttttaaaaggtgtccagtgtgaggagcagctggtggagtccgggggaggcttaggttcagcctgggaagtccctgagactctcctgtgcagcctctggattcacctttgacagctatgccatgacctgggtccgccaggctccagggaagggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcaacccatactactttgactactggggccg

SEQ ID NO: 459787 - DNA, 539 bp, Homo sapiens
  misc_feature: HEFZJCU01BULIG.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggtccgtttcatgtctggggccaagggacgctggtcaccgtctcttcagcctccaccaagggcccatcggtcttcccctggccaccctcctccaagagcacctctggggcacagcc

SEQ ID NO: 459788 - DNA, 503 bp, Homo sapiens
  misc_feature: HEFZJCU01A6L8T.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagcgtggagtttcctagttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaagggctggagtggctcgcacttatttacagtggcggcactacatactacacagacttcgcgagggccgattcaccatctccagagacgattccaagaacacgttgtatctcaatgaacagcctgacagtcgacgacacggccatgtattttgtgcgagcgacccggggctcctcatggctttcattacg

SEQ ID NO: 459789 - DNA, 501 bp, Homo sapiens; identical to SEQ ID NO: 455940
  misc_feature: HEFZJCU01A4I7K.11.19.B08.1.454.heavy.3.raw

SEQ ID NO: 459790 - DNA, 538 bp, Homo sapiens
  misc_feature: HEFZJCU01CSMIN.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactgggccagggcaccctggtcaccgtctcctcagcttcaccaagggcccatcggtcttcccctgcgccctgctccacggagcgacctctcggggtcggacgaacgcggcccgtcggggcgtcggtccgtcgggttccaagggtaactacctttacccgtactaa

SEQ ID NO: 459791 - DNA, 508 bp, Homo sapiens
  misc_feature: HEFZJCU01EPGUV.48.44.D11.1.454.heavy.3.raw
agtatacatacacgaccggtgctcgatttagcgcagtacgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctcccgagacgcacagcggccctggggctgcctggtcaaggactacttcctatgtatact

SEQ ID NO: 459792 - DNA, 486 bp, Homo sapiens; identical to SEQ ID NO: 444861
  misc_feature: HEFZJCU01A0RTO.47.55.E11.1.454.heavy.3.raw

SEQ ID NO: 459793 - DNA, 518 bp, Homo sapiens
  misc_feature: HEFZJCU01ELY54.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcggtcttcccctgcgcctgctcaggagcactcg

SEQ ID NO: 459794 - DNA, 384 bp, Homo sapiens; identical to SEQ ID NO: 444454
  misc_feature: HEFZJCU01CEI1K.11.61.F06.1.454.heavy.3.raw

SEQ ID NO: 459795 - DNA, 525 bp, Homo sapiens; identical to SEQ ID NO: 459784
  misc_feature: HEFZJCU01EP0V0.16.9.A09.1.454.heavy.3.raw

SEQ ID NO: 459796 - DNA, 507 bp, Homo sapiens
  misc_feature: HEFZJCU01D06PE.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaaggccatcggtcttcccctggcaccctcctccaagagcacctctgggggcacagcggccctgggctgcctggtcaaggactacttcctacgtcgtat

SEQ ID NO: 459797 - DNA, 485 bp, Homo sapiens
  misc_feature: HEFZJCU01ENIY1.51.76.G10.1.454.heavy.3.raw
cgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcccgggaggtccctgagactctcctgtgcagcctctggattcaccttcagtgcctatggcatgcactgggtccgccaggctccaggcaaggggctggagtgggtggcatttatatcagatgatggcagtaataaagagtatgcagtctccgtgaagggccgattcaccatctccagagacaattcccagaacacactgtatctgcaaatgaacagattgagagctgagacacggctgtgtattctgtgacgaaacgctatgagtgggtaa

SEQ ID NO: 459798 - DNA, 513 bp, Homo sapiens; identical to SEQ ID NO: 446699
  misc_feature: HEFZJCU01ENY4K.12.25.C03.1.454.heavy.3.raw

SEQ ID NO: 459799 - DNA, 414 bp, Homo sapiens; identical to SEQ ID NO: 453362
  misc_feature: HEFZJCU01DBH6K.40.81.H04.1.454.heavy.3.raw

SEQ ID NO: 459800 - DNA, 517 bp, Homo sapiens
  misc_feature: HEFZJCU01CEZF8.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaaggacacctccacaaaccaggtggtccttacaatgaccaatatggaccctgtggacacagccacatattactgttcacgctctatggttcggggagttattagtccctactttgactactggggccagggactctggtcaccgtctccgcagcctccaccaagggcccatcc

SEQ ID NO: 459801 - DNA, 531 bp, Homo sapiens
  misc_feature: HEFZJCU01BMGIJ.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaacccgtggtcaccgtctccccaccctccaaccg

SEQ ID NO: 459802 - DNA, 513 bp, Homo sapiens; identical to SEQ ID NO: 446452
  misc_feature: HEFZJCU01COBME.17.33.C11.1.454.heavy.3.raw

SEQ ID NO: 459803 - DNA, 499 bp, Homo sapiens
  misc_feature: HEFZJCU01CVFQY.21.86.H09.1.454.heavy.3.raw
tcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtcgagaggccttgagtggctgggaaggacattctacaggtccagatggtattctgattatgcagtgtctgtgagaagtcgaatggacatcactacagacccaccgaagaatcagttctccctgcatttgcactctgtgactcccgacgacacggctgtctactattgtgtaagacatcccacagggggctccacactcgaccctggggccagggaaccctagtcaccgtctcctcagcctccaccaagggcccatcggtcttcccctggcgccctgctccaggagcacctccgacg

SEQ ID NO: 459804 - DNA, 488 bp, Homo sapiens
  misc_feature: HEFZJCU01CG12R.47.55.E11.1.454.heavy.3.raw
agctcacgtacacgaccggtgctcgatttagcactcgcacgttgggtttgggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccagggaaccctggtcagcgtctcctcagcctccaccaagggcccatcggtcttccccctggtcgccctgctccaggagcacctccgagagcacagcggccctgggctgcctggtcaaggactacttcctacgtgagct

SEQ ID NO: 459805 - DNA, 520 bp, Homo sapiens
  misc_feature: HEFZJCU01DAHP5.10.85.H08.1.454.heavy.3.raw
catagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctatgggttcggacctctgggggcccagggtaacccg

SEQ ID NO: 459806 - DNA, 516 bp, Homo sapiens
  misc_feature: HEFZJCU01CUWNE.4.25.C03.1.454.heavy.3.raw
agcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgtttctgcaaatgaacagcctgagagccgaggacacggctgtgtatcactgtgtcagagatgccgagggcggttacccctctggttccttcgacagttatggtatggacgtctggggcctagggactacggtcaccgtctcctcagcctccaccaacgggcccatcggtcttcccctcggcta

SEQ ID NO: 459807 - DNA, 515 bp, Homo sapiens
  misc_feature: HEFZJCU01DIWL3.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcgccctggctgcctggtcaaggactacttcagacgtatca

SEQ ID NO: 459808 - DNA, 506 bp, Homo sapiens
  misc_feature: HEFZJCU01EMNJL.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccggggggtccctgagactgtcctgtgtagtctctgggttcagcgtcagtcgcgaccacatgagttggttccgccaggctccagggaagggctggagtggctcgcacttatttacagtggcggcactacatactacacagacttcgcgaggggccgattcaccatctccagagacgattccaagaacacgttgtatcttcaaatgaacagctgacagtcgacgacacggccatgtatttttgtgcgagcgacccggggctcctcaatggctttcatttacg

SEQ ID NO: 459809 - DNA, 527 bp, Homo sapiens
  misc_feature: HEFZJCU01A5BBT.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaacctggtcaccgtctcctcacgcctccacc

SEQ ID NO: 459810 - DNA, 513 bp, Homo sapiens
  misc_feature: HEFZJCU01DY7CM.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaagggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatacctactttgactacgtggggacccg

SEQ ID NO: 459811 - DNA, 521 bp, Homo sapiens
  misc_feature: HEFZJCU01DVMGD.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgaccctggggccagggaacccaggtcaccgtctcctcagcctccaccaagggcccatccgtctcccctggcgccctcgctccaggagcacctccgagagcacagcggccctgggctgcctggtcaaggactacttcctaccg

SEQ ID NO: 459812 - DNA, 519 bp, Homo sapiens
  misc_feature: HEFZJCU01BI8IG.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatcctccagagacttttctcagaacacactgtctcttcaaatgaacagcctgagggccgaggacacggccgtctattattgtgtgagtagtttatggcgatggctgggtggacgagatcacgtgggggccac

SEQ ID NO: 459813 - DNA, 525 bp, Homo sapiens; identical to SEQ ID NO: 445545
  misc_feature: HEFZJCU01CUCB7.12.86.H09.1.454.heavy.3.raw

SEQ ID NO: 459814 - DNA, 523 bp, Homo sapiens
  misc_feature: HEFZJCU01BFD2T.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaaggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccactaggtttgactacgtggggccaggggaagcttggtcaccgtctcctcagcctcc

SEQ ID NO: 459815 - DNA, 530 bp, Homo sapiens
  misc_feature: HEFZJCU01CIFU0.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatgggggcccacggaacgttactaacgcgtatgacgtctggggccgaagggaccac

SEQ ID NO: 459816 - DNA, 493 bp, Homo sapiens
  misc_feature: HEFZJCU01BJ42N.49.39.D06.1.454.heavy.3.raw
agtcgagagacacgaccggtgctcgatttagtgacatctcgcagttctttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcaactggtggagtctgggggaggcgtggtccagcctgggaggtccctgagactctcctgtgcagcctctggagttaccttcagcagctatgctatgcactggttccgccaggctccaggcaaggggctggagtgggtggcagttatttcatatgatggaagcgataaatactacgcagactccgtgaagggccgagtcaccatctccagacacaattccaagaacacggtgtttctgctggtgaacagcctgagaactgaggacacggctgtgtattactgtgcggcaggcaacgta

SEQ ID NO: 459817 - DNA, 518 bp, Homo sapiens; identical to SEQ ID NO: 450435
  misc_feature: HEFZJCU01ECUFS.13.76.G10.1.454.heavy.3.raw

SEQ ID NO: 459818 - DNA, 463 bp, Homo sapiens; identical to SEQ ID NO: 445513
  misc_feature: HEFZJCU01BLJB1.2.28.C06.1.454.heavy.3.raw

SEQ ID NO: 459819 - DNA, 519 bp, Homo sapiens
  misc_feature: HEFZJCU01DFQN7.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctcgtgggggcacagcggccctggctgcctggtcaaggactacttccagacgtatca

SEQ ID NO: 459820 - DNA, 509 bp, Homo sapiens
  misc_feature: HEFZJCU01B99YG.53.10.A10.1.454.heavy.3.raw
cgcgtatacacacgaccggtgctcgatttagcgtcgatctcaggggtctgagagaggagccttagtcctggaatccaaggcctctccacttggtgatcagcactgagcaccgaggattcaccatggaactggggctccgctgggttttccttgttgctattttagaaggtgtccactgtgaggaacaactggtggagtctgggggaggcctggtcaagcctggggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgagttcaccatctccagagacaacgccgcgagttcagtgtttctgcagatgcacaacttgagagtcgaagacacggcggtctatttctgcgcgaggaaaagtcgcattccagagcctgtacgcccgccttc

SEQ ID NO: 459821 - DNA, 514 bp, Homo sapiens
  misc_feature: HEFZJCU01B2XAF.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctgcgccctgctccaggagcacctctgggggcacagcggcccg

SEQ ID NO: 459822 - DNA, 494 bp, Homo sapiens
  misc_feature: HEFZJCU01EUIF0.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttccccctggcaccctcctccaagagcacctctgggggcacagcggccctgggctgcctggtcaaggactacttcgagtagta

SEQ ID NO: 459823 - DNA, 526 bp, Homo sapiens
  misc_feature: HEFZJCU01EP3F0.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggccagggaaccctggtgaccgtctcctcagcctccaccaagggcccatcggtcttcccctggcgccctgctccaggagcacctccgagacgcacagcggccctgggcg

SEQ ID NO: 459824 - DNA, 522 bp, Homo sapiens
  misc_feature: HEFZJCU01EG91B.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgtctgggggccaggggaccctggtcatcgtctccccagcctccaccaagggcccatcggtcttcccctggccg

SEQ ID NO: 459825 - DNA, 501 bp, Homo sapiens; identical to SEQ ID NO: 447123
  misc_feature: HEFZJCU01CRQXZ.3.20.B09.1.454.heavy.3.raw

SEQ ID NO: 459826 - DNA, 379 bp, Homo sapiens; identical to SEQ ID NO: 444450
  misc_feature: HEFZJCU01B5K2A.47.77.G11.1.454.heavy.3.raw

SEQ ID NO: 459827 - DNA, 505 bp, Homo sapiens
  misc_feature: HEFZJCU01CHGHZ.3.63.F08.1.454.heavy.3.raw
agacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgtagtttggtttgggcgggatagcagcgggtaccc

SEQ ID NO: 459828 - DNA, 372 bp, Homo sapiens; identical to SEQ ID NO: 444727
  misc_feature: HEFZJCU01EBL8H.3.42.D09.1.454.heavy.3.raw

SEQ ID NO: 459829 - DNA, 316 bp, Homo sapiens; identical to SEQ ID NO: 444444
  misc_feature: HEFZJCU01A8RFE.47.56.F01.1.454.heavy.3.raw

SEQ ID NO: 459830 - DNA, 527 bp, Homo sapiens
  misc_feature: HEFZJCU01D6KVW.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtactccgaccgttggagtcagggaactctggtcaccgtctcctcacgcctccaccaacgggcccatccggtccttccccctggccgccctgcctccgaggagcaccctccgagacgcacagccggccctgggcctc

SEQ ID NO: 459831 - DNA, 515 bp, Homo sapiens
  misc_feature: HEFZJCU01C4CD8.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctgggccagggaaccctggtcaccgtctcctcagcctccaccaacgggcccatcggtcttccccctggccaccctcctccaagagcacctctgggggcacagcggccctgggctgcctgggtcaaggactacttccgtactacg

SEQ ID NO: 459832 - DNA, 504 bp, Homo sapiens
  misc_feature: HEFZJCU01CM7TQ.10.28.C06.1.454.heavy.3.raw
catagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtggagtcggggggaggcttggtacagcctggggggtccctgagactctcctgtgtagcgtctggattcacattcagtagttatagcatgaactgggtccgccaggctccagggaaggggctgggagtgggtttcatatattgatagaaatagtggaaccatatactatgcagactctgtgaggggccgattcaccatctccagagacaatgccaggaattcactgtatgtggaaatgaacagtctgagagccgaggacacggctctctattactgtgcgagagccccgaaatagggtctacg

SEQ ID NO: 459833 - DNA, 389 bp, Homo sapiens
  misc_feature: HEFZJCU01DO047.40.42.D09.1.454.heavy.3.raw
tctagcgactcacgaccggtgctcgatttagacacatacgcagggaaaggggctggagtgggttggccgtgttaagaccaaacctgagggtggggcaatagactacgctgcacccgtgacaggcagattcgccatctcaagagatgattcagcaggcacggtgtatctggaaatgaacagcctgaaagccgaggacacagccgtgtattattgtaccgcagggctcggctactccgatactgactattgggccagggaaccctggtcaccgtctcctcagcctccaccaagggcccatcggtcttccccctggcgccctgctccaggagcacctccgagagcacagcggccctgggctgcctggtcaaggactacttccagtcgctaga

SEQ ID NO: 459834 - DNA, 502 bp, Homo sapiens; identical to SEQ ID NO: 451203
  misc_feature: HEFZJCU01B8SIJ.10.38.D05.1.454.heavy.3.raw

SEQ ID NO: 459835 - DNA, 513 bp, Homo sapiens; identical to SEQ ID NO: 459667
  misc_feature: HEFZJCU01DHT6S.16.2.A02.1.454.heavy.3.raw

SEQ ID NO: 459836 - DNA, 464 bp, Homo sapiens
  misc_feature: HEFZJCU01DKGC2.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacgggggaaaattggggccagggaaccctggtctccgtctcgtcagcctcaccaagggcccatcggtcttcccctggcgccctgctccaggagcacctccgagaggcacagcggccctgggctgcctggtcaaggactacgttcccacgagagta

SEQ ID NO: 459837 - DNA, 480 bp, Homo sapiens
  misc_feature: HEFZJCU01EGTAG.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgtcgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaaggcccatcggtcttcccctgcacctcctccaagagcacctctgggggcacagcggccctgggctgcctggtcaaggactacttccgtatctctcg

SEQ ID NO: 459838 - DNA, 498 bp, Homo sapiens
  misc_feature: HEFZJCU01CMCR4.53.80.H03.1.454.heavy.3.raw
cgcgtatacacacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacacgtccatcagcactgcctacatggagctgaccaggctgaaatttggaggacacggccatttattactgtgcaaggaacagcataatgactcgtccccggactttcg

SEQ ID NO: 459839 - DNA, 520 bp, Homo sapiens
  misc_feature: HEFZJCU01DHRAW.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatgggtctcagttattcataccgacggtaccatatatgacgcagactccgtgaagggccgattcaccatctccagagaccattccaagaacaccctatatcttcaaatgaacaacctgagagtcgaagacacggccgtatattactgtgcgagacatgacttcggtgacccctggggccagggaaccctggtccaccgtctcctcag

SEQ ID NO: 459840 - DNA, 528 bp, Homo sapiens
  misc_feature: HEFZJCU01EXHUX.51.9.A09.1.454.heavy.3.raw
cgatcgtatacacgaccggtgctcgatttagcgagacgcgcagggggccttagccctggattccaaggcatttccacttggtgatcagcactgaacatagaggactcaccatggagttgggactgtgctgggttttccttgttgctattttagaaggtgtccagtgtgaggtgcggctggtggagtctgggggaggcttggtacagcctggggggtccctgacactctcctgtgcagcctctggattcccccttcagaacttatgaaatgaactgggtccgacaggctccagggaaggggctggagtgggtttcacacattagtagtggtggaagtaccatattctacgcagactttgtgcagggccgattcaccatctccagagacgacgccaagaattcactgtatctgaaaatgaacagcctgagagccgacgacacggctgtttattactgtgcgagagattactatcatagtagtggttttttccctactactccggtatggacgtctggggccaagggaccg

SEQ ID NO: 459841 - DNA, 506 bp, Homo sapiens
  misc_feature: HEFZJCU01CSQM9.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgacttctggggccagggg

SEQ ID NO: 459842 - DNA, 490 bp, Homo sapiens
  misc_feature: HEFZJCU01DGVMJ.19.53.E09.1.454.heavy.3.raw
tactctcgtgcacgaccggtgctcgatttagagagagtgtgttgggtttggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagcggcctgggctgcctggtcaaggacctacttcccacgagagta

SEQ ID NO: 459843 - DNA, 514 bp, Homo sapiens
  misc_feature: HEFZJCU01CZLPZ.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaagggctggaatgggtctcaggtattactggtggtggttataccacatactacgcagactccgtgaaggggccggttcaccatcctccagagacaattccaagaacacactgtatctgcaaatgaacagcctgagagccgacgacacggccatatattactgtgcgaaagcaccggcagttagtcacccatacctactttgactactggggccaac

SEQ ID NO: 459844 - DNA, 527 bp, Homo sapiens
  misc_feature: HEFZJCU01CGFJM.53.2.A02.1.454.heavy.3.raw
cgcgtatacacacgaccggtgctcgatttagactcatctacaggggatactttctgagagtcctggacctcctgtgcaagaacatgaaacatctgtggttcctccttctcctggtggcagctcccagatgggtcctgtcccaggtgcagctgcaggagtcgggcccaggactcgtgaagccttcggagaccctgtccctcacctgcattgtctctggtggctccatcagtacttactactggacctggatccggcggtccccagggaggggactggagtggattgggaatggtccgttacagtgggaccaccaactacaacccctccctcaagagtcgagtcaccatatcagtagacacgtccaagaaccgcttctccctgaatctgaactctgtgaccgctgcggacacggccctctattactgtgcgagagtctacgcgccggacgacgatatttgactggttatcacaacccactatattactttgactactggggccagggaaccctggtcaccgtcctcctc

SEQ ID NO: 459845 - DNA, 537 bp, Homo sapiens
  misc_feature: HEFZJCU01CRO4P.18.59.F04.1.454.heavy.3.raw
tacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacatcccctgaaagcgtcaactactactactacgtatggacctctgggccaagggacc

SEQ ID NO: 459846 - DNA, 468 bp, Homo sapiens
  misc_feature: HEFZJCU01DG0XS.49.10.A10.1.454.heavy.3.raw
agtcgagagacacgaccggtgctcgatttagcgtcgatctcaggggtccgggagatcatgagggtgtccttgggttttggggggaagaggaagactgacggtccccccaggagttcaggtgctgggcacggtgggcattggtgactcatgtggaagacagaaaattgtacgcagactccgtgaggggccgattcatcatctccaaagactactccaagaatacggtgtatcttcaaatgaatggcctcgtttttgcggacacggctgtttattattgtgcgacagggggccccccctttcaggagcgatcatactactttgaccactggggccagggaaccctggtcaccgtctcctcagcctccaccaagggcccatcggtcttccccctggcaccctcctccaagagcacctctggggcacagcggccctgggctgcctggtcaaggactacttcctctctcgact

SEQ ID NO: 459847 - DNA, 505 bp, Homo sapiens
  misc_feature: HEFZJCU01BRCZ9.52.34.D01.1.454.heavy.3.raw
  modified_base (461)..(461): a, c, t, g, unknown or other
cgcagtacgacacgaccggtgctcgatttagatcgtctgtgttgggtttgggggaggcttggtaaagcggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttcccctggcaccctcctccaagagcacctctgggggcaacngcggccctgggctgcctggtcaaggactacttcctatacgatcg

SEQ ID NO: 459848 - DNA, 500 bp, Homo sapiens
  misc_feature: HEFZJCU01CVQTQ.53.24.C02.1.454.heavy.3.raw
cgcgtatacacacgaccggtgctcgatttagtacagatcgttagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacacgtccatcagcactgcctacatggagctgaccaggctgaaatttgaggacacggccattttattactgtgcaaggaacagcataatgactcgtccccggactttgtac

SEQ ID NO: 459849 - DNA, 507 bp, Homo sapiens
  misc_feature: HEFZJCU01DES92.49.49.E05.1.454.heavy.3.raw
agtcgagagacacgaccggtgctcgatttagagcgactagcaacacacaaagggggagagtcatggatctcatgtgcaagaaagtgaagcacctgtggttcttcctcctgctggtggcggctcccagatgggtcctgtcccagctgcagctacaggagtcgggcccaggactgctgaagccttcggagaccctgtccctcacctgcactgtctctggtggttccttcagtagtccttattactactggggctgggtccgccagcccccagggaagggcctggagtggattgcgaatatctactatagtgggagcacctactacaatccttccctcaagagtcgcgtcactgtgtccgtggacacgtccaagaataaagtctccctgaacctgaactctgtgaccgccgcagacacggctgtctattactgtgccagaacgcggaaatccctacacaatgatgcttttgatgtctggggccatgggacaatgtcaccgtctcttcacg

SEQ ID NO: 459850 - DNA, 501 bp, Homo sapiens
  misc_feature: HEFZJCU01CK6F1.11.27.C05.1.454.heavy.3.raw
cgagagataccacgaccggtgctcgatttagacgcgatcgaagggtttggggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagaggagctattatctggaaccccgat

SEQ ID NO: 459851 - DNA, 462 bp, Homo sapiens; identical to SEQ ID NO: 444770
  misc_feature: HEFZJCU01A9X7B.40.23.C01.1.454.heavy.3.raw

SEQ ID NO: 459852 - DNA, 374 bp, Homo sapiens; identical to SEQ ID NO: 444502
  misc_feature: HEFZJCU01DOUEG.9.14.B03.1.454.heavy.3.raw

SEQ ID NO: 459853 - DNA, 400 bp, Homo sapiens; identical to SEQ ID NO: 444452
  misc_feature: HEFZJCU01ER0AA.47.24.C02.1.454.heavy.3.raw

SEQ ID NO: 459854 - DNA, 400 bp, Homo sapiens; identical to SEQ ID NO: 444452
  misc_feature: HEFZJCU01BH0WP.47.24.C02.1.454.heavy.3.raw

SEQ ID NO: 459855 - DNA, 514 bp, Homo sapiens
  misc_feature: HEFZJCU01AMIVG.16.39.D06.1.454.heavy.3.raw
tgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcacccgggcagttagtcacccatactacttt

SEQ ID NO: 459856 - DNA, 504 bp, Homo sapiens
  misc_feature: HEFZJCU01COOUA.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctggcaccctcctccaagagcacctctgggggcacagcggcctgggctgcctggtcaaggctacttccgagtagtaca

SEQ ID NO: 459857 - DNA, 500 bp, Homo sapiens; identical to SEQ ID NO: 445807
  misc_feature: HEFZJCU01DOVQS.40.81.H04.1.454.heavy.3.raw

SEQ ID NO: 459858 - DNA, 515 bp, Homo sapiens
  misc_feature: HEFZJCU01CLQN6.51.31.C09.1.454.heavy.3.raw
cgatcgtatacacgaccggtgctcgatttagacgtctcatcaaggaaggaagggggctctgagagaggagcccagccctgggattttcaggtgttttcatgtggtgatcaggactgaacagagagaactcaccatggagtctgggctgacgtggctttttcttgtggctattttaaaaggtgtccagtgtgacgtgcagctggtggagtctgggggaggcttgatacagccgggggggtccctgagactctcatgtagaacctctggcttcatgtttagagtctatgacatgagttgggtccgccaggctccggggaaggggctggagtgggtctcaatgatcagtgatggtggaacgaccacaaactacgccgactccgtgaagggccggtgcaccatctccagagacaattcgaaggacactttatatctgcaactcaacagactgacacccgcggacacggccgtctactactgtgtgaaagaagacggaccgctggacgaggagccagagg

SEQ ID NO: 459859 - DNA, 481 bp, Homo sapiens
  misc_feature: HEFZJCU01CIS0Y.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgtttctgcaatgaacagcctgagaattgaggactcgggtatatactactgtgcccgtgacccctgactgataaaccggactggttcgaccctgggccagggaacct

SEQ ID NO: 459860 - DNA, 519 bp, Homo sapiens
  misc_feature: HEFZJCU01CV5TM.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggcccatcggtcttccccctggcaccctcctccaagagcacctctgggggcacagcggccctgggctgcctggtcaaggactacttcctagagacacg

SEQ ID NO: 459861 - DNA, 506 bp, Homo sapiens; identical to SEQ ID NO: 444696
  misc_feature: HEFZJCU01DHD2R.16.34.D01.1.454.heavy.3.raw

SEQ ID NO: 459862 - DNA, 488 bp, Homo sapiens; identical to SEQ ID NO: 444617
  misc_feature: HEFZJCU01E1SR6.4.6.A06.1.454.heavy.3.raw

SEQ ID NO: 459863 - DNA, 512 bp, Homo sapiens
  misc_feature: HEFZJCU01BHFL1.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatgaacagcctgaagaccgaggacacagccgtctattactgtgttagggtagttttacgtatttttggta

SEQ ID NO: 459864 - DNA, 518 bp, Homo sapiens; identical to SEQ ID NO: 445220
  misc_feature: HEFZJCU01ADBDT.9.70.G04.1.454.heavy.3.raw

SEQ ID NO: 459865 - DNA, 505 bp, Homo sapiens; identical to SEQ ID NO: 447076
  misc_feature: HEFZJCU01DWSZK.10.38.D05.1.454.heavy.3.raw

SEQ ID NO: 459866 - DNA, 490 bp, Homo sapiens
  misc_feature: HEFZJCU01C88DF.4.53.E09.1.454.heavy.3.raw
agcactgtagcacgaccggtgctcgatttagagagagtgtgttgggtttggggggtccctgagactctcctgtacagtctctgcatctaccttcacttctttttggatgacctggctccgccgggctccagggagggggctggagtgggtggccaccatcaatcaagatggaagtgagagaacctatgtggactctgtgaagggccgattcaccatctccagagacaacgccaagaattctctgtatctgcaaatgaacagcctgagagccgaggactcggctgtctattactgtgcgaggaagaagtattactatgatacaagtgacatgggctggttcgacccctggggccagggaaccctggtcaccgtctcctcagcctccaccaacgggcccatcggtcttcccctcggcgccctgctccaggagcacctccgagagcacagcggccctgggctgcctggtcaggactaccttccctacagtgct

SEQ ID NO: 459867 - DNA, 512 bp, Homo sapiens; identical to SEQ ID NO: 447721
  misc_feature: HEFZJCU01B5MLF.17.33.C11.1.454.heavy.3.raw

SEQ ID NO: 459868 - DNA, 513 bp, Homo sapiens; identical to SEQ ID NO: 446452
  misc_feature: HEFZJCU01EFAYX.17.33.C11.1.454.heavy.3.raw

SEQ ID NO: 459869 - DNA, 497 bp, Homo sapiens
  misc_feature: HEFZJCU01ESZW6.51.71.G05.1.454.heavy.3.raw
cgatcgtatacacgaccggtgctcgatttagtgtcgtcgcaagagagaggggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcg

SEQ ID NO: 459870 - DNA, 511 bp, Homo sapiens; identical to SEQ ID NO: 448280
  misc_feature: HEFZJCU01B6LLY.16.71.G05.1.454.heavy.3.raw

SEQ ID NO: 459871 - DNA, 494 bp, Homo sapiens; identical to SEQ ID NO: 445100
  misc_feature: HEFZJCU01AF36P.52.53.E09.1.454.heavy.3.raw

SEQ ID NO: 459872 - DNA, 504 bp, Homo sapiens
  misc_feature: HEFZJCU01B6F26.52.42.D09.1.454.heavy.3.raw
cgcagtacgacacgaccggtgctcgatttagacacatacgcagggaaaggggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctgggggggcgtggtccaggctgggaggtccctgagactctcctgtgcagcctctggattcaccttcagtacccatgaaatgcactgggtccgccaggctccaggcaaggggctggagtggggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctacg

SEQ ID NO: 459873 - DNA, 510 bp, Homo sapiens
  misc_feature: HEFZJCU01DNCGS.49.62.F07.1.454.heavy.3.raw
agtcgagagacacgaccggtgctcgatttagtagtcgcataaagggaaagggtctgtgaagccttcacagaccctgtccctcacctgcgctgtctctggtggctccatcaccagtggtggttattcctggacttggatccggcagccaccagggaaggccctggagtggattgggcacatctatcatagtgggaccacctactacaacccgtccctccagagtcgagtcaccatatcagtcgacatgtccgagaaccagttctccctgtacctccactctgtgaccgccgcggacacggccgtctattactgtgccagaggggaactctacttcggggagttaggaatcgctcctgcatttgacatctggggccagggaaacctggtcaccgtctcctcagcctccaccaagggcccatcggtcttcccctcggcaccctcctccaagagcacctctgggggcacagcggccctgggctgcctggtcaaggactacttcctctctcgact

SEQ ID NO: 459874 - DNA, 490 bp, Homo sapiens
  misc_feature: HEFZJCU01BQTTD.52.76.G10.1.454.heavy.3.raw
cgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctgggggaggcgtggtccagcctgggaggtccctgagactctcctgtgcaggctctgcatttcccttcaataactatgctatcgattgggtccgccaggctccaggcaagggactggagtgggtggcagtaatatcagctgatggaggcactaaatattacgcagattctgcgaggggccgattcaccatatccagagacaactcccaagatatgatatatctacaaatgaacagcctgagacctgaggacacggctgtatattactgtgcgtcgagggggcaggtgccg

SEQ ID NO: 459875 - DNA, 482 bp, Homo sapiens; identical to SEQ ID NO: 445068
  misc_feature: HEFZJCU01A9HVH.11.23.C01.1.454.heavy.3.raw

SEQ ID NO: 459876 - DNA, 502 bp, Homo sapiens
  misc_feature: HEFZJCU01BRVLG.15.55.E11.1.454.heavy.3.raw
tctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtgaaaacacatattacgcaggctccgtgaagggccgcttcaccatctccagagacaattccaacaacacactttatcttcaaatgaacagcctgcgagccgaggacacggccgtatactactgtgcgagagatcgaacaggcccgtgggagcccgttgactactggggccagggaaccctggtcaccgtctcctcaacctccaccaagggcccatcggtcttcccctggcaccctcctccagagcacctctgggggcacagcggccctgggctgcctggtcaaggactacttccgctacgtaga

SEQ ID NO: 459877 - DNA, 402 bp, Homo sapiens
  misc_feature: HEFZJCU01AQRCA.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctacttattgtgcgagagggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 459878 - DNA, 546 bp, Homo sapiens
  misc_feature: HEFZJCU01BUXQF.15.86.H09.1.454.heavy.3.raw
tctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaaagtaaaatgatggtgagaaaatagactacggtgcacccgtgaaaggaagattcaccatctcaagagataattcaaaacgacggtgtatttgcaaatgaacagcctgaaaaccgaggacacagccgtctattactgtaccacagattcggaagtgcatcgacgtaaaggaggctatgcttttgatatcgtggggcccaggggacaatc

SEQ ID NO: 459879 - DNA, 530 bp, Homo sapiens
  misc_feature: HEFZJCU01CRNZV.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcagcccccaggaaaggccctggaatgggttgcacttatttattgggatgacggttaccgctacagtccatctctgaggaggagactcaccatcaccaaggacaccccaaaaccaggtggtccttacaatgaccaccatggaccctgtggacacagccacatatttctgtgcacactctataggagcacctggtagtctgccaaactggttcgaccctggggcccgggaaccctggtcaccgtctcctcagcctccaccaagggcccatcggtcttcccctc

SEQ ID NO: 459880 - DNA, 480 bp, Homo sapiens; identical to SEQ ID NO: 451411
  misc_feature: HEFZJCU01EPQ3R.4.37.D04.1.454.heavy.3.raw

SEQ ID NO: 459881 - DNA, 533 bp, Homo sapiens
  misc_feature: HEFZJCU01AT2KS.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggaccaatactagtggggcttgttcgtggggccgacggggacccgtggtcatcgtcctccccacgcctccaccgaacggcccagtcggtccttccccgtggccg

SEQ ID NO: 459882 - DNA, 372 bp, Homo sapiens
  misc_feature: HEFZJCU01BQXQX.49.29.C07.1.454.heavy.3.raw
agtcgagagacacgaccggtgctcgatttagagtgctacgaagggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatccctggtcatcgtctcctcagcctccaccaagggcccatcggtcttccccctggcgccctgctccaggagcacctccgagagcacagcggccctgggctgcctggtcaaggactacttcctctctcgact

SEQ ID NO: 459883 - DNA, 506 bp, Homo sapiens
  misc_feature: HEFZJCU01ERNSW.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgttggagcttttgactactggggccagggaaccctggtcatcgtctcctcagcctccaccaagggcccatcggtcttcccctggccaccctcctccaagagcacctctgggggcacagcggccctgggctgcctggtcaaggactacttccgagtagtaca

SEQ ID NO: 459884 - DNA, 519 bp, Homo sapiens; identical to SEQ ID NO: 445330
  misc_feature: HEFZJCU01AMLPN.7.78.H01.1.454.heavy.3.raw

SEQ ID NO: 459885 - DNA, 507 bp, Homo sapiens; identical to SEQ ID NO: 446095
  misc_feature: HEFZJCU01B0KFD.10.38.D05.1.454.heavy.3.raw

SEQ ID NO: 459886 - DNA, 537 bp, Homo sapiens
  misc_feature: HEFZJCU01BGCCB.22.85.H08.1.454.heavy.3.raw
acatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggttggtaccacatactacacagactccgtgaagggccgattcaccatctcagaagacaattccaggaacacattgtatcttcaaatgaataacctgagagccgaggacacggccatgtattactgtgtggggctatttacgttgaccccgtgggggccggggaaccctgggtccaccggtcctcccccgaccctccaaccg

SEQ ID NO: 459887 - DNA, 465 bp, Homo sapiens; identical to SEQ ID NO: 445132
  misc_feature: HEFZJCU01D2KO1.5.86.H09.1.454.heavy.3.raw

SEQ ID NO: 459888 - DNA, 519 bp, Homo sapiens
  misc_feature: HEFZJCU01CCXRG.10.85.H08.1.454.heavy.3.raw
  modified_base (440)..(440): a, c, t, g, unknown or other
catagtagtgcacgaccggtgctcgatttagtatcactcagtcgcgggggtctcagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactacttgtgggctctgtgaagggccgattcaccatctccagagacaacgccaagaagtcactgtatctgcaaatgaacgatgtnagagtcgaggacacggctgtatatttctgtgcgaggggagccggctagtggtcggacctcgtggggccaggggaacccc

SEQ ID NO: 459889 - DNA, 518 bp, Homo sapiens; identical to SEQ ID NO: 451556
  misc_feature: HEFZJCU01CRT7S.13.76.G10.1.454.heavy.3.raw

SEQ ID NO: 459890 - DNA, 411 bp, Homo sapiens
  misc_feature: HEFZJCU01DZDIU.51.31.C09.1.454.heavy.3.raw
cgatcgtatacacgaccggtgctcgatttagacgtctcatcaaggaaggaaggggctggagtgggtctcaatgatcagtgatggtggaacgaccacaaactacgccgactccgtgaagggccggtgcaccatctccagagacaattcgaaggacactttatatctgcaactcaacagactgacacccgcggacacggccgtctactactgtgtgaaagaagacggaccgctggacgaggagccagaggagaatcactactttgactactggggccagggaagactggtcaccgtctcctccgcctccaccaagggcccatcggtcttccccctggcaccctcctccaagagcacctctggggacacagcggccctgggctgcctggtcaaggactacttcctcgtagcact

SEQ ID NO: 459891 - DNA, 523 bp, Homo sapiens
  misc_feature: HEFZJCU01ADD3A.7.78.H01.1.454.heavy.3.raw
cgtgtctctacacgaccggtgctcgatttagtgtgagtagtttgggtttggggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacaactgccgtttatttttgtacgagagcgtcgtctgtcagtggaattgactactggggccaggggaaccctggtcaccgtctcctcagcctccaccaagggcccatcggtcttcccctggccaccctcctccaagagcacctctgggggcacagcggccctgggctgcctggtcaaggactacttcctagagacacg

SEQ ID NO: 459892 - DNA, 500 bp, Homo sapiens
  misc_feature: HEFZJCU01EZXWG.48.9.A09.1.454.heavy.3.raw
agtatacatacacgaccggtgctcgatttagcgagacgcgcagggcacgaccggtgctcgatttagtacacacacttagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggcccgagcgcagtggtcttttg

SEQ ID NO: 459893 - DNA, 514 bp, Homo sapiens
  misc_feature: HEFZJCU01BZ4Y0.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgacgagcacagcggcccctcggg

SEQ ID NO: 459894 - DNA, 492 bp, Homo sapiens
  misc_feature: HEFZJCU01DF5JY.52.77.G11.1.454.heavy.3.raw
cgcagtacgacacgaccggtgctcgatttagctagtcactcaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtgtctatgacatgcactgggtccgccaggctccaggcaaggggctggagtgggtggcagttatatcatatgatggaagtaagatatactatgcagactccgtgaagggccgattcaccatttccagagacaactccaagaacacgctgtatttgcaaatgaacagcctgagagctgaggacacggctgtgtattactgtgcgaacttaatcacggaac

SEQ ID NO: 459895 - DNA, 525 bp, Homo sapiens
  misc_feature: HEFZJCU01CVPHZ.12.40.D07.1.454.heavy.3.raw
atacgacgtacacgaccggtgctcgatttagtgatagagcgtaacaacagagggctcaccatggagtttgggctgagcggtgggttttcctcgttgctcttttaagaggtgtccagtgtcaggggcacctggtggagtctgggggagccgtggtccagcctgggcggtccctgacactcgcctgtgttgcctctggatttcctttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagaggacacacgaacctactggccaatacctatgggggcttgttctggggccaggggaccctggtcatcgtctccccagcctccaccaagggcccatcggtcttcccctggcg

SEQ ID NO: 459896 - DNA, 513 bp, Homo sapiens
  misc_feature: HEFZJCU01CW4V4.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagcgtgcgttttcttagtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccaac

SEQ ID NO: 459897 - DNA, 510 bp, Homo sapiens
  misc_feature: HEFZJCU01CUYP2.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaagggctggagtgggtaggtttcattagagccatggcttatgctgggacaacagaatacgccgcgtctgtgaaagggcagattcatcatctcaagagatgattccaacggcatcgcctatctgcagatgaacagcctgaagaccgaggacacagccgtctattactgtgttagggagttttacgtatttttggt

SEQ ID NO: 459898 - DNA, 512 bp, Homo sapiens
  misc_feature: HEFZJCU01D17BN.13.76.G10.1.454.heavy.3.raw
  modified_base (457)..(457): a, c, t, g, unknown or other
tcacgtactacacgaccggtgctcgatttagtcactcatacagggggggagaggagcccagcactgggattccgaggtgtttccattcggtgatcagcactgaacacagaggactcaccatggagttttggctgagcgtggtttcgtgtaggctatttaaaaggtgccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattctgtncgagagatggggcccacgaacgttctacgctatggacgtctggggccaagggacc

SEQ ID NO: 459899 - DNA, 495 bp, Homo sapiens; identical to SEQ ID NO: 445359
  misc_feature: HEFZJCU01BPB28.4.21.B10.1.454.heavy.3.raw

SEQ ID NO: 459900 - DNA, 504 bp, Homo sapiens
  misc_feature: HEFZJCU01B0H50.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggccatcggtcttcccctggcacctcctccaagagcacctctgggggcacagcggccctgggctgcctggtcaaggactacttccgagtagtaca

SEQ ID NO: 459901 - DNA, 395 bp, Homo sapiens; identical to SEQ ID NO: 444517
  misc_feature: HEFZJCU01D1WA7.16.68.G02.1.454.heavy.3.raw

SEQ ID NO: 459902 - DNA, 351 bp, Homo sapiens
  misc_feature: HEFZJCU01CUUTM.49.4.A04.1.454.heavy.3.raw
agtcgagagacacgaccggtgctcgatttagagtagtgatcagggacattgactccgtgaagggccgattcatcatctccagagacaactccgagaacacactgtatcttcaaatgaacaggttgagagctgaagacacggctttatattactgtgcgaacttaatcacggaggacaacggtgacccccgtccgctcggtgcggaggtctggggccaagggaccacggtcatcgtctcctcagcctccaccaagggcccatcggtcttccccctggcaccctcctccaagagcacctctgggggcacagcggccctgggctgcctggtcaaggactacttcctcctcgact

SEQ ID NO: 459903 - DNA, 339 bp, Homo sapiens; identical to SEQ ID NO: 444436
  misc_feature: HEFZJCU01D0W09.47.38.D05.1.454.heavy.3.raw

SEQ ID NO: 459904 - DNA, 486 bp, Homo sapiens
  misc_feature: HEFZJCU01BKLGJ.10.85.H08.1.454.heavy.3.raw
catagtagtgcacgaccggtgctcgatttagtatcactcagtcgggggctgggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctatggttcggacctctggggccagggaaccctggtcaccgtctcatcagcctccaccaagggcccatcggtcttccccctggcgccctgctccaggagcacctccgagagcacagcggccctggctgcctggtcaaggactacttcccactactat

SEQ ID NO: 459905 - DNA, 389 bp, Homo sapiens
  misc_feature: HEFZJCU01ESV1G.49.26.C04.1.454.heavy.3.raw
agtcgagagacacgaccggtgctcgatttagtctagcgactttgggtttgggatatcaaatgatgcaagtaacaaatactatgtagactccgtgaagggccgattcaccatctccagagacaattccaagaatacgctgtatctgcacatgaactagcctgagagtccgaagacacgggtgtttattactgtgcgaacttaattacggaggacaacggtaaccccggtccgcacggtacggacgtctggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 459906 - DNA, 495 bp, Homo sapiens
  misc_feature: HEFZJCU01EB8JA.51.64.F09.1.454.heavy.3.raw
cgatcgtatacacgaccggtgctcgatttagcgcgtatacaaggggctgggagaggagcccagcactagaagtcggcggtgtttccattcggtgatcagcactgaacacagaggactcaccatggagtttgggctgagctgggttttcctcgtcgttcttataagaggtgtccagtctgaggcgcagctggtggagtctgggggaggagtggtccagcctgggaggtcctcgagactctcctgtgcagcctctggattcaccttcagagtctatggcatgaactgggtccgccaggctccaggcaaggggctggagtgggtggcattcatttcagaggatggaattaagagatactatacagactccgtgaagggccgattcaccatctccagagacaattccaagaactcgctctatctgcaaatgagcagcctgagacctgaggacacggctgtctattactgtgacgaaacggatgagtggaactagggttt

SEQ ID NO: 459907 - DNA, 519 bp, Homo sapiens; identical to SEQ ID NO: 445886
  misc_feature: HEFZJCU01DJX7B.10.79.H02.1.454.heavy.3.raw

SEQ ID NO: 459908 - DNA, 515 bp, Homo sapiens
  misc_feature: HEFZJCU01C3T9E.3.6.A06.1.454.heavy.3.raw
agacgcactccacgaccggtgctcgatttagatctactgacagggggggaaatactttctgagagtcctggacctcctgtgcaagaacatgaaacatctgtggttcttccttctcctggtggcagctcccagatgtgtcctgtcccaggtgcacctgcaggagtcgggcccaggactggtgacgccttcggagaccctctccctcacctgcactgtctctggtggctccatcagtcgtttttacactactggagttggatccggcagtccccagggaagggactagagtgggttggccatatgcatcacagtgggagcaccaactacaacccctccctcgagagtcgagtcaccatatcaatagacacgtccaagaaccagttctccctgagcttgaagtctgtcaatgctgcggacacggccgtttattactgtgcgagtactgcggggaaagatccatttgatatttggggccaaggaacaatggtcaccgtctcttcagcctccaccaaggg

SEQ ID NO: 459909 - DNA, 518 bp, Homo sapiens
  misc_feature: HEFZJCU01BLIUK.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccacagactccgtgaggggccgattcaccatctccagagacaattccaagaacacgctgtttcttcaaatgaacagcctgagagccgatgacacggccgtgtattactgtgcgagagatggggcccacgaacgttactacgctatgacgtctggggccaagggaccg

SEQ ID NO: 459910 - DNA, 495 bp, Homo sapiens
  misc_feature: HEFZJCU01AFKMB.47.55.E11.1.454.heavy.3.raw
  modified_base (465)..(465): a, c, t, g, unknown or other
agctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtnttttcgatgcttcggtccgcgggacttcgt

SEQ ID NO: 459911 - DNA, 504 bp, Homo sapiens
  misc_feature: HEFZJCU01A26Q1.52.86.H09.1.454.heavy.3.raw
cgcagtacgacacgaccggtgctcgatttagtgctatagacttgggtttgggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcggagagggaactcgattacagcagccctacg

SEQ ID NO: 459912 - DNA, 512 bp, Homo sapiens
  misc_feature: HEFZJCU01AQ8ZP.48.19.B08.1.454.heavy.3.raw
agtatacatacacgaccggtgctcgatttagtgagtcagtaagggggctttctgagagtcatggatctcatgtgcaagaaaatgaagcacctgtggttcttcctcctcctggtggcggctcccagatgggtcctgtcccagctgcagctgcaggagtcgggcccaggactggtgaagccttcggagaccctgtccctcacctgcactgtctctggtgactccatcagcagtagtacttactactggggctggatccgccagcccccagggaaggggctggagtggattgggagtatctattatagtgggagtacctactacaacccgtccctcaagagtcgactcaccatatccgtagacacgtccaagaaccagttctccctgaagctgagctctgtgaccgccgcagacacggctgtgtattactgtgcgagggggccgggatattgttatagaaccacctgctatctgagctggttcgactgctggggccagggaaccctggtctaccg

SEQ ID NO: 459913 - DNA, 516 bp, Homo sapiens
  misc_feature: HEFZJCU01AJH89.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttcccctggcaccctcctccaagagcacctctggtggcacagcggccctgggctgcctggtcaaggactacttccgagtagta

SEQ ID NO: 459914 - DNA, 500 bp, Homo sapiens; identical to SEQ ID NO: 445720
  misc_feature: HEFZJCU01AMB63.3.20.B09.1.454.heavy.3.raw

SEQ ID NO: 459915 - DNA, 481 bp, Homo sapiens
  misc_feature: HEFZJCU01BJOQN.19.71.G05.1.454.heavy.3.raw
tactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtcccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagaggccccataga

SEQ ID NO: 459916 - DNA, 518 bp, Homo sapiens
  misc_feature: HEFZJCU01DDAXR.52.78.H01.1.454.heavy.3.raw
cgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggttgttgtcgttgcaccagctgccctacccggctgctacttcgatctctggggccgtggcaccctggtcactgtcttctcagcctccaccaagggcccatcggtcttcccctggccaccctcctccaagagcacctctgggggcacagcggccctgggctgcctggtcaaggactacttcctatacg

SEQ ID NO: 459917 - DNA, 506 bp, Homo sapiens
  misc_feature: HEFZJCU01A5Q90.26.80.H03.1.454.heavy.3.raw
agactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaagtgaagaagcctggggcctcagtgaaggtctcctgcaaggcttctggatacaccttcaccgcctactatatccactgggtgcggcaggcccctggacaagggcttgagtggatgggacacatcagccctaacactggtgacacaaactatgcacagagatttcagggcagggtcaccatgaccacggacacgtccataagcacagtttacatggaggtaaataggctgagatctgacgacacggccgtatattactgtgcgttattaacggacgattacgattgttttgtatttggtttttacg

SEQ ID NO: 459918 - DNA, 508 bp, Homo sapiens
  misc_feature: HEFZJCU01CRLF2.47.48.E04.1.454.heavy.3.raw
agctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccagggaaggggctggagtgggttggcaacataaatccagatggaagtcagaaaacctatgtggactctctgaagggccgattcaccatctccagagacaacgccaagaactctctgtttctgcaaatggacagcctgagagtcgaagacacggctgtgtattactgtgtgtctctgacgcctcggccggaccttggcttcgg

SEQ ID NO: 459919 - DNA, 519 bp, Homo sapiens
  misc_feature: HEFZJCU01EUP9G.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccattcaccatctccagagacaattccaagaacacgctgtttcttcaaatgaacagcctgagagccgatgacacggccgtgtattactgtgcgagagatggggcccacgaacgttactacgctatggacgtcgtggggccaagggaccg

SEQ ID NO: 459920 - DNA, 509 bp, Homo sapiens; identical to SEQ ID NO: 447939
  misc_feature: HEFZJCU01EV9G7.17.25.C03.1.454.heavy.3.raw

SEQ ID NO: 459921 - DNA, 509 bp, Homo sapiens
  misc_feature: HEFZJCU01DIQBR.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgtttcatctgaaggatgttcaatactatacagactccgtgaacgggccgattcaccatctccagagacaattccaagaacacgatgtatctgcaaatggacagcctaagagttgaggacacggctgtttattactagttacgaaagagggggatacgagtggcgagctcaagtacttacg

SEQ ID NO: 459922 - DNA, 505 bp, Homo sapiens; identical to SEQ ID NO: 447076
  misc_feature: HEFZJCU01BHHRA.10.38.D05.1.454.heavy.3.raw

SEQ ID NO: 459923 - DNA, 521 bp, Homo sapiens
  misc_feature: HEFZJCU01D9XGU.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaagggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcgggggacctcaccctggtctacttcgatctctggggcc

SEQ ID NO: 459924 - DNA, 388 bp, Homo sapiens
  misc_feature: HEFZJCU01AHYNW.11.20.B09.1.454.heavy.3.raw
cgagagataccacgaccggtgctcgatttagtgtagtgtgaaggggtacgtgccaagcgatcctcgtgcgaccgccgagagcccggggagcgggggcttgccggccgattcaccatctcccgagacgattccaacaatatgttctatctgcaaatgagccgcctgagaagcaaggacacggctgtctattactgtgcgagagacggatttctgcactctacctactacttcttctacatggacgtctggggcagagggacaacggtcaccgtctccttagcctccaccaagggcccatcggtcttccccctggcaccctcctccaagagcacctctgggggcacagcggccctggctgcctggtcaaggactacttccgtatctctcg

SEQ ID NO: 459925 - DNA, 518 bp, Homo sapiens
  misc_feature: HEFZJCU01BSE86.9.43.D10.1.454.heavy.3.raw
tgatacgtctcacgaccggtgctcgatttagactagcagtaaggggctgggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatgggtctcagttattcataccgacggtaccatatatgacgcagactccgtgaagggccgattcaccatctccagagaccattccaagaacaccctatatcttcaaatgaacaacctgagagtcgaagacacggccgtatattactgtgcgagacatgacttcggtgacccctggggccagggaaccctggtcaccgtctcct

SEQ ID NO: 459926 - DNA, 527 bp, Homo sapiens; identical to SEQ ID NO: 450092
  misc_feature: HEFZJCU01D6I9N.18.33.C11.1.454.heavy.3.raw

SEQ ID NO: 459927 - DNA, 467 bp, Homo sapiens; identical to SEQ ID NO: 445004
  misc_feature: HEFZJCU01CC894.16.78.H01.1.454.heavy.3.raw

SEQ ID NO: 459928 - DNA, 511 bp, Homo sapiens
  misc_feature: HEFZJCU01C6IQW.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaacacagggactgcagtggattggatacatctacttcagtgggaaccccaactacaacccctcctcaggagtccagtcgccatatccctggactcgtccaacaaccagatctccctgacgatgacatctgtgaccgctgcggacacagccgtttattactgtgcgcgatctgggcgactcagtgactatggtatggacgtctggggccaagggaccacggtcatcgtctcctcagcctccaccaaggcccatcggtcttccccctggcta

SEQ ID NO: 459929 - DNA, 499 bp, Homo sapiens
  misc_feature: HEFZJCU01DT1D3.26.23.C01.1.454.heavy.3.raw
agactatactcacgaccggtgctcgatttagtacacgtgattagggattgggaggcgtggtccagcctgggggctccctgagactctcctgtacaacgtctggattcaacttcaattattatgttctacactgggtccgccaggctccaggcaaggggctggagtgggtggcaggtatgtcacatgatggattcagtagatactacatagactccgtgaagggccgatcgaccatctccagagacgtttccgagaacacattaaatctggaaataaacttcgtgagaagtgacgactcggccgtttattttgtgcgagagaggggtacagtagcggccgagctccggcctttgaccactggggccagggaaccctggtcaccgtctcctcagcctccaccaagggcccatcggtcttcccctgcgccctgctccaggagcacctccgagagcacagcggccctgggctgcctggtcaaggactacttccagtatagtct

SEQ ID NO: 459930 - DNA, 376 bp, Homo sapiens; identical to SEQ ID NO: 447797
  misc_feature: HEFZJCU01EIBI8.49.72.G06.1.454.heavy.3.raw

SEQ ID NO: 459931 - DNA, 528 bp, Homo sapiens
  misc_feature: HEFZJCU01ESEIV.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatggggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttgggccagggaaccctggtcaccgtctcctcagcctccaccaaggcccatcggtcttcccctggcacctcctccaagagcacctctggggcacagcggcctgggctgcctc

SEQ ID NO: 459932 - DNA, 399 bp, Homo sapiens
  misc_feature: HEFZJCU01C6KO7.51.59.F04.1.454.heavy.3.raw
cgatcgtatacacgaccggtgctcgatttagtacacacacttagggattggggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttccccctggcaccctcctccaagagcacctctgggggcacagcggccctgggctgcctggtcaaggactacttcctcgtagcact

SEQ ID NO: 459933 - DNA, 507 bp, Homo sapiens
  misc_feature: HEFZJCU01DQ47E.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtgggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaaagtgacgtggtagttccggggggacacatgacaccgg

SEQ ID NO: 459934 - DNA, 497 bp, Homo sapiens; identical to SEQ ID NO: 457759
  misc_feature: HEFZJCU01DDYTJ.13.33.C11.1.454.heavy.3.raw

SEQ ID NO: 459935 - DNA, 513 bp, Homo sapiens
  misc_feature: HEFZJCU01ET02M.13.21.B10.1.454.heavy.3.raw
tcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagcctggggggtccctgagactctcctgtcaagcctctgggttcagcttcagtgtatattggatgagctgggtccgccagactccagggaaggggctggagtgggtggccaacataaacacagacggaagtgacccatactatgcggactctgtgaagggccgattcaccatctccagagacaacgccaagaactcactatatttgcaaatggaccgcctgagagacgaggacacggctatgtattactgtgcgagagatgagagtggctacagttggggccgggaacctggtcaccgtcaac

SEQ ID NO: 459936 - DNA, 480 bp, Homo sapiens; identical to SEQ ID NO: 455424
  misc_feature: HEFZJCU01DIPM1.7.10.A10.1.454.heavy.3.raw

SEQ ID NO: 459937 - DNA, 521 bp, Homo sapiens
  misc_feature: HEFZJCU01ARLV2.13.55.E11.1.454.heavy.3.raw
tcacgtactacacgaccggtgctcgatttagcactcgcacgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacggcaaatatggttcagggagttcgactactggggccagggaaccctggtcaccgtctcctcagcctccaccaaggg

SEQ ID NO: 459938 - DNA, 400 bp, Homo sapiens; identical to SEQ ID NO: 444452
  misc_feature: HEFZJCU01EDNIP.47.24.C02.1.454.heavy.3.raw

SEQ ID NO: 459939 - DNA, 481 bp, Homo sapiens
  misc_feature: HEFZJCU01DCLBA.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtggaagggactgctggggccagggagcccttgtcaccgtctcctcagcctccaccaagggcccatcggtcttcccctggcgccctgctccaggagcacctccgagagcacagcggccctgggctgcctggtcaggactacttcccactactatg

SEQ ID NO: 459940 - DNA, 502 bp, Homo sapiens
  misc_feature: HEFZJCU01ER28E.3.67.G01.1.454.heavy.3.raw
agacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaaatgaacagcctggaagacgcggacacagccatgtattattgtacattaggacactatacg

SEQ ID NO: 459941 - DNA, 525 bp, Homo sapiens; identical to SEQ ID NO: 450208
  misc_feature: HEFZJCU01BC4JI.3.82.H05.1.454.heavy.3.raw

SEQ ID NO: 459942 - DNA, 325 bp, Homo sapiens
  misc_feature: HEFZJCU01BUHR5.18.17.B06.1.454.heavy.3.raw
tacgagtatgcacgaccggtgctcgatttagtcgatagtgaagggccgattcaccatctccagagacaattaccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagagcacagcggccctgggctgcctggtcaaggactacttcccatactcgta

SEQ ID NO: 459943 - DNA, 397 bp, Homo sapiens
  misc_feature: HEFZJCU01DFGZH.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcaccctccgagagcacagcggccctgggctgcctggtcaaggactacttcctacgtgagct

SEQ ID NO: 459944 - DNA, 507 bp, Homo sapiens; identical to SEQ ID NO: 454310
  misc_feature: HEFZJCU01AZ1TC.16.34.D01.1.454.heavy.3.raw

SEQ ID NO: 459945 - DNA, 519 bp, Homo sapiens; identical to SEQ ID NO: 452709
  misc_feature: HEFZJCU01B3GNE.3.82.H05.1.454.heavy.3.raw

SEQ ID NO: 459946 - DNA, 508 bp, Homo sapiens
  misc_feature: HEFZJCU01BNF7P.47.23.C01.1.454.heavy.3.raw
agctcacgtacacgaccggtgctcgatttagtacacgtgattagggattggggcccaacaatcacatccctcctcagaagcccccagagcacaactccttaccatggactggacctggaggatcgtctttttggtggcagcagccacaggtgcccactcccaggtccaacttgtgcagtctggggctgaggtgaagaagcctggggcctcagtgaaggtttcctgtcaggcttctggatacagcttcactagtcatgctatacattgggtgcgccaggcccccggacagagacctgagtggatgggatggatcagcattggcaatggtaacataaaacactcacagaagttccagggcagggtcaccattaccagagacatctccgcgaccacagcctacatggaactgagcagcctgacttctgaagacacggctatttactactgtgcgagagaggggtttgactgggaactccttctacatggacgtctggggcaaaggggaccg

SEQ ID NO: 459947 - DNA, 503 bp, Homo sapiens; identical to SEQ ID NO: 459423
  misc_feature: HEFZJCU01DN83E.15.55.E11.1.454.heavy.3.raw

SEQ ID NO: 459948 - DNA, 511 bp, Homo sapiens
  misc_feature: HEFZJCU01BJSOS.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatccctccgggacagacttaccatgaccacgaactcctccataaacacagcctacatggagttgaggagcctgacatctgacgacacggccgtctattactgtgcgagacgtcccacgactccggtgacgcctacggcaggcggtcctttgacctttcgtc

SEQ ID NO: 459949 - DNA, 518 bp, Homo sapiens
  misc_feature: HEFZJCU01E1XSC.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccaagagcacctctgggggcacagcggcccgtggctgcctggtcaaggactacttctagagacacg

SEQ ID NO: 459950 - DNA, 539 bp, Homo sapiens
  misc_feature: HEFZJCU01AD9E7.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtggtattactgtgcgagatgtaggaaaagtaatggctgtgtttattggggtccaggggagccctggtctaccg

SEQ ID NO: 459951 - DNA, 383 bp, Homo sapiens; identical to SEQ ID NO: 454363
  misc_feature: HEFZJCU01A6HBV.22.46.E02.1.454.heavy.3.raw

SEQ ID NO: 459952 - DNA, 507 bp, Homo sapiens
  misc_feature: HEFZJCU01EI6O7.52.86.H09.1.454.heavy.3.raw
cgcagtacgacacgaccggtgctcgatttagtgctatagacttgggtttggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagcctcgaagaacatcatgatggctttgatatctggggccaagggacaatggtcattgtctcttcagcctccaccaagggcccatcggtcttccccctggccaccctcctccaagagcacctctgggggcacagcgccctgggctgcctggtcaaggactacttccta

SEQ ID NO: 459953 - DNA, 516 bp, Homo sapiens; identical to SEQ ID NO: 451776
  misc_feature: HEFZJCU01AMIE5.48.34.D01.1.454.heavy.3.raw

SEQ ID NO: 459954 - DNA, 459 bp, Homo sapiens
  misc_feature: HEFZJCU01AD5XY.53.12.B01.1.454.heavy.3.raw
cgcgtatacacacgaccggtgctcgatttagtagtgtagattccgcgggcaccttgaccaactactatttacagtggttgcgacaggtccctggacaagggcttgagtggatgggaagaatcaaccctaatgatggaagtgcaacaaatgcgctgaaatttcagggcagaataaccctgaccagggacacgtccacgagcacagtctacatggaattgagcagcctaacatctgaagacacggccgtctattactgtgcgagagaatatcgtttatagtgggagctgccccaagatcgccattccactttgactactggggccagggaacactggtcaccgtctcctcagcctccaccaagggcccatcggtcttccccctggcaccctcctccaagagcacctctgggggcacagcggccctgggctgcctggtcaaggactactcctcgtacctgcg

SEQ ID NO: 459955 - DNA, 529 bp, Homo sapiens
  misc_feature: HEFZJCU01D2ER7.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataacttatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttggggccagggaaccctggtcaccgtctcctcagcctccaccaagggcccatcggtcttcccctggcaccctcctccaagagcacctctgggggcacagcggccctgggctg

SEQ ID NO: 459956 - DNA, 403 bp, Homo sapiens; identical to SEQ ID NO: 444540
  misc_feature: HEFZJCU01ENKSS.16.72.G06.1.454.heavy.3.raw

SEQ ID NO: 459957 - DNA, 479 bp, Homo sapiens; identical to SEQ ID NO: 447128
  misc_feature: HEFZJCU01D1K8W.4.37.D04.1.454.heavy.3.raw

SEQ ID NO: 459958 - DNA, 510 bp, Homo sapiens
  misc_feature: HEFZJCU01DKTBW.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatgaacagcctgaataccgaggacacagccgtctattactgtgttagggagttttacgagtttttggt

SEQ ID NO: 459959 - DNA, 414 bp, Homo sapiens; identical to SEQ ID NO: 453362
  misc_feature: HEFZJCU01BPW95.40.81.H04.1.454.heavy.3.raw

SEQ ID NO: 459960 - DNA, 504 bp, Homo sapiens
  misc_feature: HEFZJCU01CT17R.11.72.G06.1.454.heavy.3.raw
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcacactggaagcagagtctatgcggagagattccagggcagagtcaccctgaccacagagacatccacgaccacagtctacatggagctgtggagcctgagacctgacgacacggccctctattactgtgcgaggccctatcctacagtgaccactccacgctggttcgacctctggggcc

SEQ ID NO: 459961 - DNA, 499 bp, Homo sapiens
  misc_feature: HEFZJCU01BSV92.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaatttgataggctctatggactggactttc

SEQ ID NO: 459962 - DNA, 488 bp, Homo sapiens
  misc_feature: HEFZJCU01CVBHY.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgcctgctccaggagcacctccgagagcacagcggccctgggctgcctggtcaggactacttcccatacctcgta

SEQ ID NO: 459963 - DNA, 379 bp, Homo sapiens
  misc_feature: HEFZJCU01EHR8O.3.59.F04.1.454.heavy.3.raw
agacgcactccacgaccggtgctcgatttagtacacacacttagggactggagtggatagggaatacttattacgatgggcgcaccaactataacgtcttactcaggagtcgggtcaccatatcagtggacacgtccaacaacaacttctccctgaggctgacctctgtgaccgccgcagacacggccatttatcactgtgggagacaatgtagtgggggtgactgccccgaatactggggccagggaacccgggtcaccgtctcctcagcctccaccaagggcccatcggtcttccccctggcgccctgctccaggagcacctccgagagcacagcggccctgggctgcttggtcaaggactacttccgagtgcgtct

SEQ ID NO: 459964 - DNA, 520 bp, Homo sapiens
  misc_feature: HEFZJCU01DH2CZ.48.38.D05.1.454.heavy.3.raw
agtatacatacacgaccggtgctcgatttagtatctgatagttgggtttgggagggctttgttggagaccttgcacttggactcctgtgccccaccatggacacactttgctccacgctcctgctgctgaccatcccttcatgggtcttgtcccagatcaccttgaaggagtctgggccaacgctggtgaaacccacacagaccctcacgctgacctgcaccttctctgggttctcactcaccactgatgaggtgggtgtggcctggatccgtcagcccccgggaaaggccccggagtggcttggattgatttatggggatggtgacaagcgttacagtgcatctctgaagaccagactctccatcaccaaggacacctccaagaacgaggttgtcctttccttggccaacatgcaccctgtggacacggccacttatttttgtacacacaccatcttgacgactggggatgcttttcatttctggggccaggggaccgtggtcgccgtgtctacagcct

SEQ ID NO: 459965 - DNA, 387 bp, Homo sapiens; identical to SEQ ID NO: 444635
  misc_feature: HEFZJCU01C7HKO.11.27.C05.1.454.heavy.3.raw

SEQ ID NO: 459966 - DNA, 499 bp, Homo sapiens
  misc_feature: HEFZJCU01BCX3F.13.87.H10.1.454.heavy.3.raw
tcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaaggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattatgtgacaaagatccaaccccttacgt

SEQ ID NO: 459967 - DNA, 490 bp, Homo sapiens; identical to SEQ ID NO: 454974
  misc_feature: HEFZJCU01EJIPR.19.53.E09.1.454.heavy.3.raw

SEQ ID NO: 459968 - DNA, 510 bp, Homo sapiens; identical to SEQ ID NO: 453944
  misc_feature: HEFZJCU01EK0GI.48.34.D01.1.454.heavy.3.raw

SEQ ID NO: 459969 - DNA, 507 bp, Homo sapiens
  misc_feature: HEFZJCU01DGI66.4.23.C01.1.454.heavy.3.raw
agcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatgcacagacgttccagggcagagtcaccattaccacagacacatccacgagcacagcctacatggacctgaggagcctgagatttgacgacacggccatatattactgtgcgagagattggcgacggaaccttgactactgggccagggaaccctggtcaccgt

SEQ ID NO: 459970 - DNA, 477 bp, Homo sapiens
  misc_feature: HEFZJCU01DB4DX.26.78.H01.1.454.heavy.3.raw
agactatactcacgaccggtgctcgatttagtgtgagtagtttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagttactatactatgcactgggtccgccaggctccaggcaaggggctggagtgggtggcagttatatcatatgatggaagcagcacatattacacagactccgtgaagggccgattcaccatctccagagacaatttgaagaacacgctgtatctgcaaatgaacagcctgagagctgaagacaggctgtgttttactgtgcgagagaga

SEQ ID NO: 459971 - DNA, 515 bp, Homo sapiens
  misc_feature: HEFZJCU01BKTEK.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaaagggccgattcaccatctccagagacaattccaggaacacaatgtatttggaaatgaacagcctaagtcctgaggacacgggtgtatactactgtacgaaggaggggggaaccaggcggagttccaagtactcctttgacgtctgggcc

SEQ ID NO: 459972 - DNA, 486 bp, Homo sapiens
  misc_feature: HEFZJCU01AM02R.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgccctgctccaggagcacctccgagagcacagcggccctggctgcctggtcaggactactcccatactcgta

SEQ ID NO: 459973 - DNA, 483 bp, Homo sapiens
  misc_feature: HEFZJCU01CH4HK.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttccccctggccgccctgctccaggagcacctccgagagcacagccggccctgggctgcctggtcaaggactacttccacgcgtatgt

SEQ ID NO: 459974 - DNA, 519 bp, Homo sapiens; identical to SEQ ID NO: 444867
  misc_feature: HEFZJCU01CESXQ.9.34.D01.1.454.heavy.3.raw

SEQ ID NO: 459975 - DNA, 504 bp, Homo sapiens
  misc_feature: HEFZJCU01C2KPW.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgaccttctc

SEQ ID NO: 459976 - DNA, 507 bp, Homo sapiens
  misc_feature: HEFZJCU01DAZ60.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaagggctggagtggctcgcacttatttacagtggcggcactacatactacacagacttcgcgaggggccgattcaccatctccagagacgattccaagaacacgttgtatcttcaaatgaacagcctgacagtcgacgacacggccatgtatttttgtgcgagcgacccggggctcctcaatggctttcattacg

SEQ ID NO: 459977 - DNA, 527 bp, Homo sapiens
  misc_feature: HEFZJCU01A8F8Q.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtcttcccctggcgccctgctccaggagcacctccgagagcacagcggcccgtcgggc

SEQ ID NO: 459978 - DNA, 530 bp, Homo sapiens; identical to SEQ ID NO: 455130
  misc_feature: HEFZJCU01DYJC8.7.78.H01.1.454.heavy.3.raw

SEQ ID NO: 459979 - DNA, 502 bp, Homo sapiens
  misc_feature: HEFZJCU01DMQJ5.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgttgtttggccggtgaactactgggccagggcaccctggtcaccgtctcctcagcttccaccaagggcccatcggtcttcccctggcgccctgctccagagcacctctggggcacagcgcctgggctgcctggtcaggactactccatac

SEQ ID NO: 459980 - DNA, 507 bp, Homo sapiens; identical to SEQ ID NO: 446637
  misc_feature: HEFZJCU01DPENW.16.34.D01.1.454.heavy.3.raw

SEQ ID NO: 459981 - DNA, 480 bp, Homo sapiens; identical to SEQ ID NO: 445011
  misc_feature: HEFZJCU01D6LJ9.22.36.D03.1.454.heavy.3.raw

SEQ ID NO: 459982 - DNA, 537 bp, Homo sapiens
  misc_feature: HEFZJCU01CX87W.17.28.C06.1.454.heavy.3.raw
  modified_base (525)..(525): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaaagtaatggctgtgtttattggggccagggganccctggtcaccg

SEQ ID NO: 459983 - DNA, 467 bp, Homo sapiens; identical to SEQ ID NO: 445004
  misc_feature: HEFZJCU01ANQMQ.16.78.H01.1.454.heavy.3.raw

SEQ ID NO: 459984 - DNA, 529 bp, Homo sapiens
  misc_feature: HEFZJCU01ERXB1.12.1.A01.1.454.heavy.3.raw
atacgacgtacacgaccggtgctcgatttagacgtctcatcagggggggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagtagtagttattactactggggctggatccgccagcccccaggggaggggctgaagtggattgggagtgtctattatagtgggatcacctactacaacccgtccctcaagagtcgagtcaccatatccgtcgacacgtccaagaaccagttctccctgaagctgagctctgtgaccgccgcagacacggctgtgtattactgtgcgagacagccaaagacagtattttgggagttgggttactggttggacttaccttttgacttactgggggccaggggaaccccttgggtaccg

SEQ ID NO: 459985 - DNA, 512 bp, Homo sapiens
  misc_feature: HEFZJCU01CIMAD.13.9.A09.1.454.heavy.3.raw
tcacgtactacacgaccggtgctcgatttagcgagacgcgcagggggggagaggagccccagccgtgagattcccaggagtttccacttggtgatcagcactgaacacagaccaccaaccatggagtttgggcttacttgggttttccttgttgctattttaaaaggtgtccaatgtgagctgcagctggtggagtctgggggaggtttggtacagccaggggcggtccctgagactctcctgtataacttctggattcaacttgggtgattatgctatgaactgggtccgccaggctccagggaaggggctggagtgggtaggtttcattaggagcaattctcatgatgggacaacagaatacgccgcgtctgtaaaaggcagattcaccatctcaagagatgagtccagaagcatcgcctttctgcagatgagtagcctgaagaccgaggacacagccatctattactgtgctagagagtattgcagtcctagacctgctatgggggtcc

SEQ ID NO: 459986 - DNA, 392 bp, Homo sapiens; identical to SEQ ID NO: 444626
  misc_feature: HEFZJCU01DKW7J.49.46.E02.1.454.heavy.3.raw

SEQ ID NO: 459987 - DNA, 518 bp, Homo sapiens
  misc_feature: HEFZJCU01EL7T0.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccaagagcacctctgggggcacagcggccctgggctgcctggtaaggactacttcctagagacacg

SEQ ID NO: 459988 - DNA, 557 bp, Homo sapiens
  misc_feature: HEFZJCU01DOC7P.47.64.F09.1.454.heavy.3.raw
agctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcaccagttttaattattggtggggctggatccgccagcccccagggaaggggctggaatggattgggagtatattttataatggggacactctttacaacccatccctcaagagtcgagtttccatatccgcagacacgtccgagaatcacttctccctgaaactgagctctgtgaccgccgcagacacggcttgtttattacttgttcgagacatgccgaccgagagcattatcggcaggttacggttttgattagttttgggggccgaaaggggtaccgaaaggggttccgaacccggttccgttacccgcgacggccccttcccaaaccc

SEQ ID NO: 459989 - DNA, 522 bp, Homo sapiens
  misc_feature: HEFZJCU01B7KX1.10.85.H08.1.454.heavy.3.raw
  modified_base (447)..(447): a, c, t, g, unknown or other
catagtagtgcacgaccggtgctcgatttagtatcactcagtcgcggggctcagagaggagccttagccctggactccaaggcctctccacttggtgatcagcactgagcgtggttttccgttgttagttatttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggngccggctagtggttcggacctctggggccaggggaacccctggtcaccgtctcatcagcctccaccaagggcccc

SEQ ID NO: 459990 - DNA, 461 bp, Homo sapiens
  misc_feature: HEFZJCU01CU3A7.4.82.H05.1.454.heavy.3.raw
  modified_base (455)..(455): a, c, t, g, unknown or other
agcactgtagcacgaccggtgctcgatttagtcgagctctctcgcggggagagcatcacccagcaaccacatctgtcctctagagaatcccctgagagctccgttcctcaccatggactggacctggaggatcctcttcttggtggcagcagccacaggagcccactcccaggtgcagctgatgcagtctggggctgaggtgaagaagcctggggcctcagtgatggtctcctgcaaggcttctggattcaccttcaccggctactatttgcactaggtgcgacaggcccctggacaagggcttgagtggatgggatggatcaaccctaatagtggtgccacacactatgcacagacttttctgggcagggtcaccatgaccagggacacgtccatcagcacagcctacatggagctgagcaggctgagatctgacgacacggccgtgtattacngtgtgt

SEQ ID NO: 459991 - DNA, 396 bp, Homo sapiens; identical to SEQ ID NO: 444568
  misc_feature: HEFZJCU01EQPGH.47.46.E02.1.454.heavy.3.raw

SEQ ID NO: 459992 - DNA, 513 bp, Homo sapiens
  misc_feature: HEFZJCU01CVC0U.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccactggagtctgggcgtgagcgtgggctttttcgttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacaccggccatatattactgtgcgaaagcaccggcagttagtcacccatactactttgactactgggg

SEQ ID NO: 459993 - DNA, 315 bp, Homo sapiens; identical to SEQ ID NO: 444422
  misc_feature: HEFZJCU01A5J54.47.84.H07.1.454.heavy.3.raw

SEQ ID NO: 459994 - DNA, 374 bp, Homo sapiens
  misc_feature: HEFZJCU01EWHJ1.49.69.G03.1.454.heavy.3.raw
agtcgagagacacgaccggtgctcgatttagtcgctgcgtaaaggagaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatccctggtcatcgtctcctcagcctccaccaagggcccatcggtcttccccctggcgccctgctccaggagcacctccgagagcacagcggccctgggctgcctggtcaaggactacttcctctctcgact

SEQ ID NO: 459995 - DNA, 500 bp, Homo sapiens
  misc_feature: HEFZJCU01C0I7M.40.81.H04.1.454.heavy.3.raw
  modified_base (491)..(491): a, c, t, g, unknown or other
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccnctggggccg

SEQ ID NO: 459996 - DNA, 521 bp, Homo sapiens
  misc_feature: HEFZJCU01ANTKK.48.24.C02.1.454.heavy.3.raw
agtatacatacacgaccggtgctcgatttagtacagatcgttagggaaaggggtctgagagaggagcccagccctgggattctcaggtgttttcatttggtgatcaggactgaacagagagaactcaccatggagtttgggctgagcgtgcgtttctaggtggctattttaaaaggtgtccagtgtgaggtgcacctgttggagtctgggggaggcttggtacagcctggggggtccctgagactctcctgtgcagcctctggattcacctttagcagctatgccatgagctgggtccgccaggctccagggacggggctggagtgggtctcagctattagtggtagtggtggtggcacatactacgcagactccgtgaagggccggttcaccatctccagagacaattccaagaacacactttatctgcgaatgaacagcctgagagccggaggacacgggccgtatatttactgtgcgaaaagaagtcaggggtttactatgatatcgggaggatttcg

SEQ ID NO: 459997 - DNA, 494 bp, Homo sapiens
  misc_feature: HEFZJCU01ET6GT.4.21.B10.1.454.heavy.3.raw
agcactgtagcacgaccggtgctcgatttagtgtcgtcgcaagagagggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaagggcccatcggtcttcccctggcgccctgctccaggagcacctccgagagcacagcggccctgggctgcctggtcaaggactacttccctacagtgct

SEQ ID NO: 459998 - DNA, 504 bp, Homo sapiens
  misc_feature: HEFZJCU01A101E.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttcccctggcgcctgctccaggagcacctccgagagcacagcggccctgggctgcctggtcaggactactccgagtgcgtct

SEQ ID NO: 459999 - DNA, 491 bp, Homo sapiens
  misc_feature: HEFZJCU01CCI7N.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggatggcacctgtatccgaccgttggagtcagggaactctggtcaccgtctcctcagcctccaccaagggcccatcggtcttcccctggcgccctgctccaggagcacctccgagagcacagcggccctgggctgcctggtcaaggactacttccgtatctctcg

SEQ ID NO: 460000 - DNA, 492 bp, Homo sapiens
  misc_feature: HEFZJCU01D4QQN.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtggagagatggaggtcgatattgta

SEQ ID NO: 460001 - DNA, 502 bp, Homo sapiens; identical to SEQ ID NO: 459025
  misc_feature: HEFZJCU01DXB8Y.48.59.F04.1.454.heavy.3.raw

SEQ ID NO: 460002 - DNA, 525 bp, Homo sapiens; identical to SEQ ID NO: 451099
  misc_feature: HEFZJCU01C8I1Q.11.25.C03.1.454.heavy.3.raw

SEQ ID NO: 460003 - DNA, 501 bp, Homo sapiens
  misc_feature: HEFZJCU01DP3W2.19.86.H09.1.454.heavy.3.raw
tactctcgtgcacgaccggtgctcgatttagtgctatagacttgggtttgggggagagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttaccg

SEQ ID NO: 460004 - DNA, 523 bp, Homo sapiens
  misc_feature: HEFZJCU01DAZMY.5.33.C11.1.454.heavy.3.raw
atcagacacgcacgaccggtgctcgatttagagtgagctcgttgggtttgggggaggcttggtccagcctggggggtccctgagactctcctgtgtagcctccggattcacctttagtgcctattggatgacctgggtccgccaggctccagggaaggggctggagtgggtggccaatataagattcgatggaagtgaggtgtactatgtggactctgtgaagggccgattcaccatctccagagacaacgccgagaactcactgtatctccaaatgaacagcctgagagccgaggacacggctgtctactactgtacgaatatcccctcgttttacgatttttggactggcccgttggggtactcctacggtttggacgtctggggccaagggaccacggtcaccgtctcctcagcctccaccaagggcccatcggtcttcccctggcgccctgctccaggagcacctccgagagcacagcgccctgggctgcctggtcaaggactacttcccgtgtctgat

SEQ ID NO: 460005 - DNA, 518 bp, Homo sapiens; identical to SEQ ID NO: 451556
  misc_feature: HEFZJCU01EQK1Z.13.76.G10.1.454.heavy.3.raw

SEQ ID NO: 460006 - DNA, 526 bp, Homo sapiens
  misc_feature: HEFZJCU01DG7PH.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacaccgaacctactggccaatactatgggggcttgttcgtggggccgaggggccctggtcatcgtctccccagcctccaccaagggcccatccggtcttccccgtggccg

SEQ ID NO: 460007 - DNA, 505 bp, Homo sapiens; identical to SEQ ID NO: 447076
  misc_feature: HEFZJCU01B3QJN.10.38.D05.1.454.heavy.3.raw

SEQ ID NO: 460008 - DNA, 482 bp, Homo sapiens
  misc_feature: HEFZJCU01AN2RQ.49.8.A08.1.454.heavy.3.raw
agtcgagagacacgaccggtgctcgatttagcatactctacaggggtgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcctctggattcaccttcagggtctatgacatgcactgggtccgccaggctccaggcaaggggctggagtgggtggcagttatatcatatgatggaagcaatatatactatgtagactccgtgaagggccgattcatcatctccagagacaattccgagaacacgctgtatctgcaaatgaacagcctgagagctgaggacacggctgtgtattactgtgcgaacttaatcacggac

SEQ ID NO: 460009 - DNA, 530 bp, Homo sapiens
  misc_feature: HEFZJCU01C9RUF.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactgggccagggaaccctggtcacgtctcctcagcctccaccaaggg

SEQ ID NO: 460010 - DNA, 432 bp, Homo sapiens; identical to SEQ ID NO: 445970
  misc_feature: HEFZJCU01D2O1T.53.65.F10.1.454.heavy.3.raw

SEQ ID NO: 460011 - DNA, 395 bp, Homo sapiens; identical to SEQ ID NO: 444923
  misc_feature: HEFZJCU01C6BWT.16.68.G02.1.454.heavy.3.raw

SEQ ID NO: 460012 - DNA, 540 bp, Homo sapiens
  misc_feature: HEFZJCU01BQWL0.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctcgcagtcgacactttgattactggggccggggaaccctggtcgccgtctcctcagcctccaccaagggcccatcggtcttccccctggccaccccctacccaagacgccacctcggtggggcacgacgccggccgtggctcgccgtcggtacgaacggtaccttacttaccgacgtacgtactcta

SEQ ID NO: 460013 - DNA, 494 bp, Homo sapiens; identical to SEQ ID NO: 450533
  misc_feature: HEFZJCU01AJOIJ.10.21.B10.1.454.heavy.3.raw

SEQ ID NO: 460014 - DNA, 396 bp, Homo sapiens; identical to SEQ ID NO: 444469
  misc_feature: HEFZJCU01CPK9Z.47.46.E02.1.454.heavy.3.raw

SEQ ID NO: 460015 - DNA, 439 bp, Homo sapiens
  misc_feature: HEFZJCU01BTWDQ.51.11.A11.1.454.heavy.3.raw
cgatcgtatacacgaccggtgctcgatttagctacgactgcagggtctatgacatgcactgggtccgccaggctccaggcaaggggctggagtgggtggcagttatatcatatgatggaagtaataaatactatgcagactccgtgaagggccgattcaccgtctccagagacaattccaagaatacgctgtatctgcacatgaacagcctgagagctgaagacacgggtgtttattactgtgcgaacttaattacggaggacaacggtaacccccgtccgcacggtacggacgtctggggccaagggaccacggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 460016 - DNA, 533 bp, Homo sapiens
  misc_feature: HEFZJCU01DOPWY.4.59.F04.1.454.heavy.3.raw
agcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtgactccataagtagtttcttctggagctggatccggcagcccccagggaagggactggagtggattggccatatctcttacagtgggagcaccaactacaacccctccctcaagagtcgtgtcaccgtgtcaatagacacgtccaagaaccagttctccctgaggctgagctctgtgaccgccgcggacacggccgtgtatttctgtgcgagatctttcgatttttggagtggtaacccccttggctactggggccagggaaccctggtcaccgtctcttcagcctccaccaagggccctacg

SEQ ID NO: 460017 - DNA, 505 bp, Homo sapiens; identical to SEQ ID NO: 445664
  misc_feature: HEFZJCU01C10YX.12.33.C11.1.454.heavy.3.raw

SEQ ID NO: 460018 - DNA, 529 bp, Homo sapiens
  misc_feature: HEFZJCU01DUV7S.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgctactgggccagggaaccctggtcaccgtctcctcagcctccaccaaggg

SEQ ID NO: 460019 - DNA, 526 bp, Homo sapiens
  misc_feature: HEFZJCU01BNPYY.3.82.H05.1.454.heavy.3.raw
agacgcactccacgaccggtgctcgatttagtcgagctctctcgcggggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttggatccagcctggggggtccctgagactctcctgtgcagcctctggcttcaccgtcagtagcagctacatgcactgggtccgccaggctccagggaagggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcggagtgggttcggggacctcgaccctggttctacttcgatctctggggcc

SEQ ID NO: 460020 - DNA, 482 bp, Homo sapiens; identical to SEQ ID NO: 444904
  misc_feature: HEFZJCU01CDJN6.47.59.F04.1.454.heavy.3.raw

SEQ ID NO: 460021 - DNA, 506 bp, Homo sapiens
  misc_feature: HEFZJCU01DFZKK.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaacctaccagaggtggcacaaagtatcgacagaactttcagggcagggtcaccatgacctgggacgcgtccatcagcacagtctacatggatctgagcgggactggacctacgtgacgaacacgggccatgtattactgtggaagagacgttggtggactccgcggggctggacctacgtcgggg

SEQ ID NO: 460022 - DNA, 516 bp, Homo sapiens
  misc_feature: HEFZJCU01BX5TO.13.4.A04.1.454.heavy.3.raw
tcacgtactacacgaccggtgctcgatttagagtagtgatcaggggtctgagagaggagcccagccctgggattttcaggtgttttcatttggtgatcaggactgaacagagagaactcaccatggaatttgggctgagctggctttttcttgtggctattttaaaaggtgtccagtgtgaagtgcagctggtggagtctgggggaggcttggtacagcctgggaggtccctgagactctcctgtgcagcctctggattcacctttagcaactatgccatgagctgggtccgccaggctccagggaaggggctggagtgggtctcaactattagtgctagtggtgccaccacatactacgcagactccgtgaagggccgattcaccatctccagagacaattccaagaacacgctgtatctgcaaatgaacagcctgagagccgaggacacggccgtatattactgtgcgaaggaatttaccctatacttttgactactggggccagggtaacccg

SEQ ID NO: 460023 - DNA, 496 bp, Homo sapiens
  misc_feature: HEFZJCU01BD8II.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttcccctggcgccctgctccaggagcacctccgagagcacagcggccctggctgcctggtcaaggactacg

SEQ ID NO: 460024 - DNA, 533 bp, Homo sapiens
  misc_feature: HEFZJCU01A8ZP8.51.78.H01.1.454.heavy.3.raw
  modified_base (525)..(525): a, c, t, g, unknown or other
cgatcgtatacacgaccggtgctcgatttagtgtgagtagtttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtctggggccaagggaccacggtcaccgtctccttagcctccaccaagggcccatcggtcttccccctggcaccctcctccaagancacctctc

SEQ ID NO: 460025 - DNA, 510 bp, Homo sapiens; identical to SEQ ID NO: 458960
  misc_feature: HEFZJCU01D9U4F.17.31.C09.1.454.heavy.3.raw

SEQ ID NO: 460026 - DNA, 506 bp, Homo sapiens
  misc_feature: HEFZJCU01BBAEO.4.67.G01.1.454.heavy.3.raw
  modified_base (481)..(481): a, c, t, g, unknown or other
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaagggctggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgcgaaagntctcgggctggttccgcggtccggg

SEQ ID NO: 460027 - DNA, 512 bp, Homo sapiens; identical to SEQ ID NO: 450914
  misc_feature: HEFZJCU01ERQHS.15.67.G01.1.454.heavy.3.raw

SEQ ID NO: 460028 - DNA, 522 bp, Homo sapiens; identical to SEQ ID NO: 446788
  misc_feature: HEFZJCU01DEL8A.12.40.D07.1.454.heavy.3.raw

SEQ ID NO: 460029 - DNA, 494 bp, Homo sapiens
  misc_feature: HEFZJCU01D8LZU.11.38.D05.1.454.heavy.3.raw
cgagagataccacgaccggtgctcgatttagtatctgatagttgggtttgggggaggcttggtacagcctggggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagtggtggtagctgctactggggccagggaaccctggtcaccgtctcctcagcctccaccaagggcccatcggtcttcccctggccaccctccctccaagagcaccctctgggggcacagcggccctgggctgcctggtcaaggactacttccgtatctctcg

SEQ ID NO: 460030 - DNA, 396 bp, Homo sapiens
  misc_feature: HEFZJCU01BX5XA.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacactgtatctacaaatgaacagcctgagagccgaggacacggccgtatatttctgtgcgaaagtctatagcagtgccccctgcgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 460031 - DNA, 484 bp, Homo sapiens; identical to SEQ ID NO: 446564
  misc_feature: HEFZJCU01C0Z9G.19.13.B02.1.454.heavy.3.raw

SEQ ID NO: 460032 - DNA, 500 bp, Homo sapiens
  misc_feature: HEFZJCU01BUHLN.21.86.H09.1.454.heavy.3.raw
tcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtcgagaggccttgagtggctgggaaggacattctacaggtccagatggtattctgattatgcagtgtctgtgagaagtcgaatggacatcactacagacccaccgaagaatcagttctccctgcatttgcactctgtgactcccgacgacacggctgtctactattgtgtaagacatcccacagggggctccacactcgacccctggggccagggaaccctagtcaccgtctcctcagcctccaccaagggcccatcggtcttcccctgcgccctgctccaggagcacctccgagag

SEQ ID NO: 460033 - DNA, 504 bp, Homo sapiens
  misc_feature: HEFZJCU01DKV79.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacatgtattggagctgaacagcctaagtcctgaggacacgggcgtatactactgtacgaaggagggggaacgagcgggagtcaagtactcctt

SEQ ID NO: 460034 - DNA, 398 bp, Homo sapiens; identical to SEQ ID NO: 444441
  misc_feature: HEFZJCU01EYFAS.4.60.F05.1.454.heavy.3.raw

SEQ ID NO: 460035 - DNA, 475 bp, Homo sapiens
  misc_feature: HEFZJCU01BP1DY.4.43.D10.1.454.heavy.3.raw
  modified_base (442)..(442): a, c, t, g, unknown or other
agcactgtagcacgaccggtgctcgatttagactagcagtaagggggctctgggagaagagccccagccccagacttcccaggagattccattcggtgatcagcactgaacacagaggactcaccatggagtttgggctgagctgggttttccttgctgctattataaaaggtgtcctgtgtcaggtgcacctggtggagtctgggggagccttggtcaagcctggagggtccctgagactctcctgtgcgacctctggattcaccttcagtgactaccagatgagctgggtccgccaggctccagggaggggctggagtggctttcatacatcactagtcgtactgagagtgcacactacgcagtctctgtgaggggccgattcaccatctccagggacaacgccaagcactcactgtatctgcagatgaacagcctgagngccgaggacacggccgtctattctgtgcgagag

SEQ ID NO: 460036 - DNA, 529 bp, Homo sapiens
  misc_feature: HEFZJCU01B05DF.16.87.H10.1.454.heavy.3.raw
tgtactactccacgaccggtgctcgatttagcagtactgcgttgggtttgggggagccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtggaaacagttatgggttggggggagttgggtttttttttcgtactacggg

SEQ ID NO: 460037 - DNA, 499 bp, Homo sapiens; identical to SEQ ID NO: 446805
  misc_feature: HEFZJCU01CNC9N.3.20.B09.1.454.heavy.3.raw

SEQ ID NO: 460038 - DNA, 509 bp, Homo sapiens
  misc_feature: HEFZJCU01D49YS.3.17.B06.1.454.heavy.3.raw
agacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgacaaatgaacagcctgacgaaccgacgacacggccgtctattattgtgtcatagacctaggatacaacgac

SEQ ID NO: 460039 - DNA, 423 bp, Homo sapiens; identical to SEQ ID NO: 444772
  misc_feature: HEFZJCU01CUH26.16.78.H01.1.454.heavy.3.raw

SEQ ID NO: 460040 - DNA, 525 bp, Homo sapiens
  misc_feature: HEFZJCU01ELUQB.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgagagtaattactataacactgctccttttacacctccctgacttctgggccatcggaacccgtccg

SEQ ID NO: 460041 - DNA, 502 bp, Homo sapiens
  misc_feature: HEFZJCU01D5YNN.51.43.D10.1.454.heavy.3.raw
  modified_base (474)..(474): a, c, t, g, unknown or other
cgatcgtatacacgaccggtgctcgatttagactagcagtaagggggagcatcacccagcaaccacatctgtcctctagagaatcccctgagagctccgttcctcaccatggactggacctggaggatcctcttcttggtggcagcagccacaggagcccactcccaggtgcagctggtgcagtccgggggtgaagtgaagaagcctggggcctcagtgaaggtctcctgcagggcctctggatacaccttcaccggctattatatccactgggtgcgacaggcccctggacaagggcttgagtggatgggatggatgaagcccaatagtggtgccacaaagacagcacagaagtttcaggtcagggtcaccatgaccagggagacgtccgtcaggacagcctatatggaggtgaccagcctgagccctgacgacaccggccatatatttctgtgcgcgaggaattcgacttcnggaataattactgggttgaaactactta

SEQ ID NO: 460042 - DNA, 495 bp, Homo sapiens; identical to SEQ ID NO: 446556
  misc_feature: HEFZJCU01BF6D5.10.71.G05.1.454.heavy.3.raw

SEQ ID NO: 460043 - DNA, 510 bp, Homo sapiens
  misc_feature: HEFZJCU01BLJ70.12.55.E11.1.454.heavy.3.raw
atacgacgtacacgaccggtgctcgatttagcactcgcacgttgggtttgggctgagctgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgacctttctggtatttcgatctctgggccgtggcaccctggtcactgtctcctcggcttccaccaagggcccatcggtcttcccctggcgccctgctccagagcacctcg

SEQ ID NO: 460044 - DNA, 507 bp, Homo sapiens
  misc_feature: HEFZJCU01D7ZCY.48.81.H04.1.454.heavy.3.raw
  modified_base (476)..(476): a, c, t, g, unknown or other
agtatacatacacgaccggtgctcgatttagtagtgtagattcgcgggggagcatcacatagcaaccacgttcctcctctaaagaagccccggggagcacagcccatcaccatggactggacctggaggttccgtctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcgcggggaggtggacggngctcggttttcgagttatcatctactacttt

SEQ ID NO: 460045 - DNA, 512 bp, Homo sapiens
  misc_feature: HEFZJCU01AZXBN.26.71.G05.1.454.heavy.3.raw
agactatactcacgaccggtgctcgatttagtgtcgtcgcaagagagagggggggggaagaggaagactgacggtcctgcgctggtggagcccacgcagaccctcacgctgacctgctccgtctctggattctcactcaccacgactgaggtgaatgtggcctgggtccgtcaggccccggaaaggccctggagtggcttgcactcatttactggagtgatctcaagcggtacaatccgtctctgaggaatcgactcaccatcaccagggacacctccaaagaccgggtggtccttacaatgaccgacatgaatcctgtggacacaggcacatattactgtgcacacagtcctagcggctacgcgagaaaagaatatgactattgggccagggaattttggtcaccgtctccccagcctccaccaaggcccatcggtcttcccctggcgccctgctccaggagcacctccgagagcacagcggccctgggctgcctgtcaaggactactcct

SEQ ID NO: 460046 - DNA, 422 bp, Homo sapiens; identical to SEQ ID NO: 445209
  misc_feature: HEFZJCU01BU8D3.3.25.C03.1.454.heavy.3.raw

SEQ ID NO: 460047 - DNA, 513 bp, Homo sapiens
  misc_feature: HEFZJCU01EXDNF.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgtcgcctggtt

SEQ ID NO: 460048 - DNA, 510 bp, Homo sapiens
  misc_feature: HEFZJCU01D1JGY.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggaccg

SEQ ID NO: 460049 - DNA, 526 bp, Homo sapiens
  misc_feature: HEFZJCU01CBB7U.48.4.A04.1.454.heavy.3.raw
agtatacatacacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttctccctgaaactgaccgctgtgaccgccgcggacacggctgtgtattactgtgcgagacgaatgggcgggtggctacgacttgacttttgggccgagggaaacctggtcaccgtcctccccagcttccaccaaggcccatcggtcttcccccg

SEQ ID NO: 460050 - DNA, 521 bp, Homo sapiens
  misc_feature: HEFZJCU01A908O.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggccaggggaccctggtcatcgtctccccagcctccaccaggcccatcggtcttcccctggccg

SEQ ID NO: 460051 - DNA, 466 bp, Homo sapiens; identical to SEQ ID NO: 445835
  misc_feature: HEFZJCU01A6VK9.9.34.D01.1.454.heavy.3.raw

SEQ ID NO: 460052 - DNA, 507 bp, Homo sapiens; identical to SEQ ID NO: 446548
  misc_feature: HEFZJCU01EF2WJ.3.81.H04.1.454.heavy.3.raw

SEQ ID NO: 460053 - DNA, 520 bp, Homo sapiens
  misc_feature: HEFZJCU01CFKP6.2.81.H04.1.454.heavy.3.raw
acgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctggtggagtccgggggaggctgggtccagcctggggggtccctgagactctcctgttcagcctctggattcacctttagtaggttttggatgagttgggtccgccaggctccagggaaggggctggagtgggtggccaacatagagtacgatggaagtgagaaaaactatgtggactccgtgaagggccgattcaccatctccagagacaacgacaagaatttagtgtatctgcaaatgagcagcctgagagccgaggacacggctgtgtattatgtgcgag

SEQ ID NO: 460054 - DNA, 508 bp, Homo sapiens; identical to SEQ ID NO: 445594
  misc_feature: HEFZJCU01A8WLQ.17.25.C03.1.454.heavy.3.raw

SEQ ID NO: 460055 - DNA, 389 bp, Homo sapiens
  misc_feature: HEFZJCU01AY3UT.48.29.C07.1.454.heavy.3.raw
agtatacatacacgaccggtgctcgatttagagtgctacgaagggaaaggggctggagtgggttggccgtgttaaaaccaaagctgagggtgggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactgactattggggccagggaaccctggtcaccgtctcctcagcctccaccaagggcccatcggtcttccccctggcgccctgctccaggagcacctccgagagcacagcggccctgggctgcctggtcaaggactacttcctagtatact

SEQ ID NO: 460056 - DNA, 497 bp, Homo sapiens; identical to SEQ ID NO: 445391
  misc_feature: HEFZJCU01DSHHP.3.26.C04.1.454.heavy.3.raw

SEQ ID NO: 460057 - DNA, 538 bp, Homo sapiens
  misc_feature: HEFZJCU01BDYW4.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactggctcggccctggggcccgggaacccgtggtcaccgtctcctcagcctccaccaagggcccatcggtcttccccctggcaccctcctccaacgacg

SEQ ID NO: 460058 - DNA, 504 bp, Homo sapiens
  misc_feature: HEFZJCU01EF9PA.47.55.E11.1.454.heavy.3.raw
agctcacgtacacgaccggtgctcgatttagcactcgcacgttgggtttgggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtctgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcggacttcgtgggccaac

SEQ ID NO: 460059 - DNA, 516 bp, Homo sapiens
  misc_feature: HEFZJCU01B8AQV.53.45.E01.1.454.heavy.3.raw
cgcgtatacacacgaccggtgctcgatttagtgagtcagtaagggaaagggtggagtctgggggagacttgatacagcctggcaggtccctgagactctcctgtgcagcctctggattcacgtttgatgattctgtcatgcactgggtccggcaaactccagggaagggcctggagtggctctcaggcattacttggaatagtggcagtacaggttatgcggactctgtgaagggccgattcaccatctccagagacaacagcaaggagctcctttatttacaaatggacagcctgagagttgaggacacggccgtatattactgtgtgaaagacagcggcccacctcgcagttggtattactattacgggatggacatctggggccgagggaccacggtcaccgtctcctcagcctccaccaacgggcccactcggtcttccccctcggcgccctgctccaggagcacctccgagagcacagcggccctgggctgcctggtcaaggactacttcc

SEQ ID NO: 460060 - DNA, 486 bp, Homo sapiens
  misc_feature: HEFZJCU01AC414.19.67.G01.1.454.heavy.3.raw
tactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagactttttctcagaacacactgtctcttcaaatgaacagcctgagggccgaggacacggccgtctattattgtgtgagagtttatggcgatggctggtggacagatcactggggccagggaaccctggtcaccgtctcctcagtctccaccaagggcccatcggtcttcccctggcgccctgctccaggagcacctccgagagcacagcgggccctggggcctgccgtggtcaaggactaccttcccacgagagta

SEQ ID NO: 460061 - DNA, 496 bp, Homo sapiens; identical to SEQ ID NO: 450059
  misc_feature: HEFZJCU01C3XK0.12.55.E11.1.454.heavy.3.raw

SEQ ID NO: 460062 - DNA, 379 bp, Homo sapiens
  misc_feature: HEFZJCU01C7EEF.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattcttttatctccagagacaattccaggaacatactgattctgcagttgaccagactgagagtcgaggacacggccgtatattattgtgttaaatgggatggtggctacgactcttggggccgggaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 460063 - DNA, 517 bp, Homo sapiens; identical to SEQ ID NO: 448515
  misc_feature: HEFZJCU01CPKBF.7.78.H01.1.454.heavy.3.raw

SEQ ID NO: 460064 - DNA, 519 bp, Homo sapiens; identical to SEQ ID NO: 446650
  misc_feature: HEFZJCU01C8ZE3.13.76.G10.1.454.heavy.3.raw

SEQ ID NO: 460065 - DNA, 488 bp, Homo sapiens
  misc_feature: HEFZJCU01BW01T.51.52.E08.1.454.heavy.3.raw
cgatcgtatacacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagcctggggcctcagtgaaggtctcctgcaagacttctggatacaccttcaccgactactatatgcactgggtgcgacaggcccctggacaagggcttgagtggatgggatggatcgaccctaagaatggtgccacaaactatgcacagacttttcagggctgggtcaccatgaccagcgacacatctagcaacacagtctacatggagttgaccagcctgaccgacacggccgtgtatttttgtgttgagagattttcggacaatccagagacccct

SEQ ID NO: 460066 - DNA, 506 bp, Homo sapiens; identical to SEQ ID NO: 445660
  misc_feature: HEFZJCU01CI591.10.12.B01.1.454.heavy.3.raw

SEQ ID NO: 460067 - DNA, 497 bp, Homo sapiens
  misc_feature: HEFZJCU01BSTH8.48.23.C01.1.454.heavy.3.raw
agtatacatacacgaccggtgctcgatttagtacacgtgattagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaat

SEQ ID NO: 460068 - DNA, 514 bp, Homo sapiens; identical to SEQ ID NO: 450253
  misc_feature: HEFZJCU01ETHC4.12.33.C11.1.454.heavy.3.raw

SEQ ID NO: 460069 - DNA, 531 bp, Homo sapiens
  misc_feature: HEFZJCU01EAUZ7.53.78.H01.1.454.heavy.3.raw
cgcgtatacacacgaccggtgctcgatttagtgtgagtagtttgggtttgggcacggtgggcatgtgtgagttttgtcacaagatttgggctcaactctcttgtccagttggtgcagtctggggctgagttgaagaagcctgggtcctcggtgaaggtctcctgcaagtattctggaggcaccttcaacaactatggtatcagctgggtgcgacaggcccctggacaagggcttgagtggatgggaagggtcacccctatttttgatgaagcagactctgcacagaagttccagggcagattaacgattacggcggacaagtccacgactaccgcctacatggagctgaccagtctgaaatctgaggacacggccctttattactgtgcgagatataccgtgggggttacggcggagatatcgccatactacttcgactactggggccagggaaccctgatcaccgtctcctcagcctccaccaagggcccatcggtcttccccctggcaccctcctccaagagcacctcg

SEQ ID NO: 460070 - DNA, 510 bp, Homo sapiens
  misc_feature: HEFZJCU01AIKZL.48.34.D01.1.454.heavy.3.raw
agtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtctcccctggcgccctgctccaggagcacctccgagagcacagcggccctgggctgcctggtcaaggactactt

SEQ ID NO: 460071 - DNA, 507 bp, Homo sapiens; identical to SEQ ID NO: 444486
  misc_feature: HEFZJCU01CDYX0.4.67.G01.1.454.heavy.3.raw

SEQ ID NO: 460072 - DNA, 427 bp, Homo sapiens; identical to SEQ ID NO: 444708
  misc_feature: HEFZJCU01ASKH5.9.34.D01.1.454.heavy.3.raw

SEQ ID NO: 460073 - DNA, 522 bp, Homo sapiens
  misc_feature: HEFZJCU01BG824.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctgggccggggaaccctggtcaccgtctcccaccctccaccaagggcccatcggtcttcccctggcaccctcctccaagagcacctctgggggcacagcggccctgggctgcctggtcaaggactacttcccgtaccgta

SEQ ID NO: 460074 - DNA, 378 bp, Homo sapiens
  misc_feature: HEFZJCU01EN0GS.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggcctgggctgcctggtcaaggactacttcctacgtgagct

SEQ ID NO: 460075 - DNA, 481 bp, Homo sapiens
  misc_feature: HEFZJCU01A3IXS.47.59.F04.1.454.heavy.3.raw
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggcccatcggtcttcccctggcgccctgctccaggagcacctccgagagcacagcggccctgggctgcctggtcaaggactactcctacgtgagct

SEQ ID NO: 460076 - DNA, 526 bp, Homo sapiens
  misc_feature: HEFZJCU01EUEGX.10.53.E09.1.454.heavy.3.raw
catagtagtgcacgaccggtgctcgatttagagagagtgtgttgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcgtcggggaataccttcagcactggggccagggcaccctggtcaccgtctcctcagcctccaccaagggcccatcggtcttcccctcggccaccctcctccaacgagcacctctgggggcacagcggccctgggctgcctc

SEQ ID NO: 460077 - DNA, 525 bp, Homo sapiens
  misc_feature: HEFZJCU01EHQKB.47.6.A06.1.454.heavy.3.raw
agctcacgtacacgaccggtgctcgatttagatctactgacagcacacaagggggggaaatactttctgagagtcctggacctcctgtgcaagaacatgaaacatctgtggttcttccttctcctggtggcagctcccacatgggtcctgtcccaggtgcagctgcaggagtcgggcccaggactggtgaagccttcggagaccctgtccctcacttgcactgtctctggtggctccatcaggagttactactggacctggcttcggcagtccccagggaagggactggagtggattgggtataattattacagtgggaccaccaactacaacccctccctcaagagtcgagtcaccatatcaatagacacgtcgaagaaccagttctccctgaagttgaactcagtgaccgctgcggacacggccgtgtattactgtgcgagccacaccgattacgattttggagtggccttgataactggggccaggggatccgtggtcaccgtctcctcagcctccaccaac

SEQ ID NO: 460078 - DNA, 508 bp, Homo sapiens
  misc_feature: HEFZJCU01EVWMC.10.28.C06.1.454.heavy.3.raw
catagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtggagtcggggggaggcttggtacagcctggggggtccctgagactctcctgtgtagcgtctggattcacattcagtagttatagcatgaactgggtccgccaggctccgagggaaggggctggagtgggtttcatatattgatagaaatagtggaaccatatactatgcagactctgtgaggggccgattcaccatctccagagacaatgccaggaattcactgtatgtaggaaatagaacagtctgagagccgagaacacggctctctattactgtgcgagacgacccgaaataggtactaacg

SEQ ID NO: 460079 - DNA, 507 bp, Homo sapiens
  misc_feature: HEFZJCU01EPKCL.10.38.D05.1.454.heavy.3.raw
catagtagtgcacgaccggtgctcgatttagtatctgatagttgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttccccctggcgccctgctccaggagcacctccgagagcacagcggccctgggctgcctc

SEQ ID NO: 460080 - DNA, 501 bp, Homo sapiens
  misc_feature: HEFZJCU01CS5F6.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactcgacgagcctgagagctgacgacacggccgtctattactgtgcgagaatgttttctgtcatcgtacatttgataggctctatggactggactttct

SEQ ID NO: 460081 - DNA, 338 bp, Homo sapiens; identical to SEQ ID NO: 444748
  misc_feature: HEFZJCU01DD9OY.11.26.C04.1.454.heavy.3.raw

SEQ ID NO: 460082 - DNA, 484 bp, Homo sapiens; identical to SEQ ID NO: 449584
  misc_feature: HEFZJCU01EQXE4.10.35.D02.1.454.heavy.3.raw

SEQ ID NO: 460083 - DNA, 407 bp, Homo sapiens
  misc_feature: HEFZJCU01D78X0.40.22.B11.1.454.heavy.3.raw
tctagcgactcacgaccggtgctcgatttagacgacagctcagggaaggggctggagtgggtttcatacattagtagtagtagtagtaccatatactacgcagactctgtgaagggccgattcaccatctccagagacaatgccaagaactcactgtatctgcaaatgaacagcctgagagacgaggacacggctgtatattactgtgcgagagagccaggtggctacaattggagatactactactactacggtatggacgtctggggccaagggaccacggtctccgtctcctcagcttccaccaagggcccatcggtcttccccctggccgccccgctccaggagcacctctgggggcacagcggcctgggctgcctggtcaaggactacttccagtcgctaga

SEQ ID NO: 460084 - DNA, 512 bp, Homo sapiens; identical to SEQ ID NO: 453122
  misc_feature: HEFZJCU01EI0DX.11.13.B02.1.454.heavy.3.raw

SEQ ID NO: 460085 - DNA, 530 bp, Homo sapiens
  misc_feature: HEFZJCU01A9PFJ.12.40.D07.1.454.heavy.3.raw
atacgacgtacacgaccggtgctcgatttagtgatagagcgtaacaacagagggctcaccatggagtttgggctgagctgggtttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagccctccaccaagggcccatccggtcttccccctggccgccctcg

SEQ ID NO: 460086 - DNA, 484 bp, Homo sapiens; identical to SEQ ID NO: 446564
  misc_feature: HEFZJCU01CWHDK.19.13.B02.1.454.heavy.3.raw

SEQ ID NO: 460087 - DNA, 503 bp, Homo sapiens; identical to SEQ ID NO: 459423
  misc_feature: HEFZJCU01D85CA.15.55.E11.1.454.heavy.3.raw

SEQ ID NO: 460088 - DNA, 518 bp, Homo sapiens
  misc_feature: HEFZJCU01CJBYT.15.28.C06.1.454.heavy.3.raw
tctacgtagccacgaccggtgctcgatttagagctcacgtattgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctcctcagcctccaccaagggcccatcggtcttcccctggcgccctgcctccaggagcacctccgagagccacagccggccctgggctgcctggtcaaggactaccttccgctacgtaga

SEQ ID NO: 460089 - DNA, 528 bp, Homo sapiens
  misc_feature: HEFZJCU01BCZ5C.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagaggggacggactacggtgactactgggggttcgacccctggggccagggaaccctggtcaccgtctcctcagcctccaaccg

SEQ ID NO: 460090 - DNA, 523 bp, Homo sapiens
  misc_feature: HEFZJCU01DU90F.51.62.F07.1.454.heavy.3.raw
cgatcgtatacacgaccggtgctcgatttagtagtcgcataaagggaaagggggcatcacataacaaccagattcctcctctaaagaagcccctgggagcacagttcatcaccatggactggacctggaagttcctctttgtggtggcagcagcaacaggtgtccagtcgcaggtccagctggtgcagtctgggactgaggtgaagaggcctgggtcctcggtgaaggtctcctgcaaggcatctaaaaacatcttaagaagttatgacatcgcctgggtgcgacaggcccctggacatgggcttgagtgggtgggcaggatcatccctatgtttggagtcgcaaactacgcacagaagttccggggcaaagtcacgttgaccgcggacacagtcacggacacagcctacatggaactcaacggcctcagatttgaggacacggccgtctattattgtgcgagagtgagaaattacggtggctactcccttgactactggggccaggggaaccctggtcaccg

SEQ ID NO: 460091 - DNA, 513 bp, Homo sapiens; identical to SEQ ID NO: 446699
  misc_feature: HEFZJCU01CDKDK.12.25.C03.1.454.heavy.3.raw

SEQ ID NO: 460092 - DNA, 471 bp, Homo sapiens
  misc_feature: HEFZJCU01AR5DP.48.1.A01.1.454.heavy.3.raw
agtatacatacacgaccggtgctcgatttagacgtctcatcaaggaaggggggtccctgagactctcctgtgcaacctctggattcacattcactagatataccatgaactgggtccgccaggctccagcgaaggggctggagtgggtctcctccataagtagtggcagttcttacttacattacgcagactcagtgaagggccgattcgccatctccagagacaacgccaacaactcactgtttctgcagatggacaacctgagaggcgaggacacggctgtatattactgtgtctccccatacatcgcagctcgtggcacggactactggggccagggaaccctagtcaccgtctcctcagcctccaccaagggcccatcggtcttccccctggcgccctgctccaggagcacctccgagagcacagcgccctgggctgcctggtcaaggactacttcctatgtatact

SEQ ID NO: 460093 - DNA, 492 bp, Homo sapiens
  misc_feature: HEFZJCU01DWQJB.40.85.H08.1.454.heavy.3.raw
tctagcgactcacgaccggtgctcgatttagtatcactcagtcgcggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccactggggccagggaaccctggtcaccgtctcctcagcctccaccaagggcccatcggtcttcccctggcgccctgctccaggagcacctccgagagcacagcggcccgtgggctgcctcggtcaaggactacttccagtcgctaga

SEQ ID NO: 460094 - DNA, 525 bp, Homo sapiens
  misc_feature: HEFZJCU01A8H9A.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggttgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagtagtttatggcgatgggctgggtggacagatcacgtggggccagggaacccc

SEQ ID NO: 460095 - DNA, 537 bp, Homo sapiens
  misc_feature: HEFZJCU01CJAFV.13.64.F09.1.454.heavy.3.raw
tcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccattaaaaccagcagttatcactgggggtggatccggcagccccccggggaaggagctggagtggatggggaggatttattatactggcaatacttacgacaatccgtccctcaagagtcgagtcaccctgtccgtggacacgccgaataaccagttctccctgaaagtgacctctgtgaccgtcgcagacacggccatttattattgtgtgagatacgacttttggaatggctatgactcgatcgactactggggccctggaatcctggtcaccgtctcctcagcctccaccaacggcccatcggtcttccccctggccaccct

SEQ ID NO: 460096 - DNA, 509 bp, Homo sapiens
  misc_feature: HEFZJCU01CEY6L.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctgactttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactgggccg

SEQ ID NO: 460097 - DNA, 502 bp, Homo sapiens; identical to SEQ ID NO: 451203
  misc_feature: HEFZJCU01BSEDA.10.38.D05.1.454.heavy.3.raw

SEQ ID NO: 460098 - DNA, 519 bp, Homo sapiens
  misc_feature: HEFZJCU01C1QUK.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaaactccttactacggtctggacgtcgtggggccgaggggacc

SEQ ID NO: 460099 - DNA, 513 bp, Homo sapiens
  misc_feature: HEFZJCU01AO5X0.10.53.E09.1.454.heavy.3.raw
catagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcgtcggggaataccttcagcactggggcc

SEQ ID NO: 460100 - DNA, 501 bp, Homo sapiens; identical to SEQ ID NO: 447719
  misc_feature: HEFZJCU01DPQ9F.17.10.A10.1.454.heavy.3.raw

SEQ ID NO: 460101 - DNA, 501 bp, Homo sapiens
  misc_feature: HEFZJCU01BCFE8.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctgggccgtggcaccctggtcactgtctcctcggcttccaccaagggcccatcggtcttcccctggcgccctgctccaggagcacctctggggc

SEQ ID NO: 460102 - DNA, 523 bp, Homo sapiens
  misc_feature: HEFZJCU01EX6OA.48.5.A05.1.454.heavy.3.raw
agtatacatacacgaccggtgctcgatttagatagatagacaggggctgagagaggagcccagccctgggattttcaggtgttttcatttggtgatcaggactgaacagagagaactcaccatggagtttgggttgagctggctttttcttgtggctattttaaaaggtgtccagtgtgaggtccagctgttggagtctgggggaggcttggtacagccgggggggtccctgagactctcctgtgcaacctctggattcacctttaggggctatgccatgaactgggtccgccaggttcctgggaaggggctggagtgggtctcatctattagtgagactggtgatactacagactacgcagactccgtgaggggccggttcaccgtctccagagacaattccaagaacacgctatttctgcaatgaacagcctgagagtcgacgacacggccgtatactactgtgcgagacagatgctgccgcctgttccgtggggccagggaaccctggtcaccgtctcct

SEQ ID NO: 460103 - DNA, 520 bp, Homo sapiens; identical to SEQ ID NO: 459242
  misc_feature: HEFZJCU01CM0F8.12.40.D07.1.454.heavy.3.raw

SEQ ID NO: 460104 - DNA, 385 bp, Homo sapiens; identical to SEQ ID NO: 444438
  misc_feature: HEFZJCU01C960T.18.60.F05.1.454.heavy.3.raw

SEQ ID NO: 460105 - DNA, 507 bp, Homo sapiens
  misc_feature: HEFZJCU01EGDWB.51.36.D03.1.454.heavy.3.raw
cgatcgtatacacgaccggtgctcgatttagctgcgtcacgatctctcttggggggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactactggggctggatccggcagccccccgggaaggggctggattggattggcagtatcagttatactgggaccaccttcttcaagtcgtcgctcaagagtcgagtcaccatgaccgcggacacgtccaaggaccagttctccctgaagctgacctctgtgaccgccgcagacacggctttgtatttctgtgctagatataatgtgggtgacagtggtgcctactacggagcttttgatatttggggccaaggcacgaaggtcaccgtctcatcacg

SEQ ID NO: 460106 - DNA, 505 bp, Homo sapiens
  misc_feature: HEFZJCU01CPVO2.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaagaggggggatacagtggcagctccaagtactta

SEQ ID NO: 460107 - DNA, 500 bp, Homo sapiens
  misc_feature: HEFZJCU01EW04V.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttccccctggcgccctgctccaggagcacctccgagagcacagcggccctgggctgcctggtcaaggactactccga

SEQ ID NO: 460108 - DNA, 479 bp, Homo sapiens
  misc_feature: HEFZJCU01CYA7M.4.37.D04.1.454.heavy.3.raw
  modified_base (478)..(478): a, c, t, g, unknown or other
agcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagcacagcctacatggacctgagcggcctgacatctgacgacacggccgtatatttctgtgcgagggng

SEQ ID NO: 460109 - DNA, 394 bp, Homo sapiens
  misc_feature: HEFZJCU01D77HW.49.41.D08.1.454.heavy.3.raw
agtcgagagacacgaccggtgctcgatttagtcacgcgagaaagggaaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 460110 - DNA, 516 bp, Homo sapiens
  misc_feature: HEFZJCU01C7DJO.4.57.F02.1.454.heavy.3.raw
agcactgtagcacgaccggtgctcgattagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctcggcgccctgctccaggagcacctctggggcgacagcggtcccg

SEQ ID NO: 460111 - DNA, 510 bp, Homo sapiens
  misc_feature: HEFZJCU01C6UWT.51.21.B10.1.454.heavy.3.raw
cgatcgtatacacgaccggtgctcgatttagtgtcgtcgcaagggggagggcatcatccaacaaccacatcccttctctacagaagcctctgagaggaaagttcttcaccatggactggacctggagggtcttctgcttgctggctgtagctccaggtgctcactccctggtgcagctggtgcagtctggggctgaggtgaagaagcctggggcctcagtgacgatttcctgtaggacatctggatacacgttcaccggctattttatgtactgggtgcgacaggcccctggacaaggccttgagtggatgggaaagatcaaccctagtggtggtaccacaagttacgcccagaaattccagggcagagtctccatgaccagaaatacgtccgcgaggacagtctacatggagttgagcagcctgagaactgacgacacggccatatattactgtgcgagagaccttgctggtccttttgacttctggggccagggaaccctggtcaccg

SEQ ID NO: 460112 - DNA, 527 bp, Homo sapiens
  misc_feature: HEFZJCU01DDV4N.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaaggcctggagtggattggatacatctattactttgggagcacctactacaacccgtcctcaagagtcgagtaacgatctcagtggacacgtctaacaatcacctctccctgaggctgagctctgtgacagccgcggacacgggcgtttattactgtgcgagagggacgactacggtgactacgtgggggttcgaccccgtggggccacgggaaccctggtcaccgtctcctcacgcctccaccg

SEQ ID NO: 460113 - DNA, 316 bp, Homo sapiens; identical to SEQ ID NO: 444479
  misc_feature: HEFZJCU01BCUQ1.47.84.H07.1.454.heavy.3.raw

SEQ ID NO: 460114 - DNA, 507 bp, Homo sapiens; identical to SEQ ID NO: 445401
  misc_feature: HEFZJCU01B2MBY.22.86.H09.1.454.heavy.3.raw

SEQ ID NO: 460115 - DNA, 409 bp, Homo sapiens
  misc_feature: HEFZJCU01BI695.52.87.H10.1.454.heavy.3.raw
cgcagtacgacacgaccggtgctcgatttagcagtactgcgttgggtttgggtccggcagccccccgggaagggcctggagtggattggagatatctactacagcgggggcaccagctacagtccctccctcaagagtcgagttggcatatcaatagacacgtccaagaatcagttctccctgaagctgaatctatcattgttgcggacacggccgtctattattgtgcgagacatggcagcccatatagtcgctggttcgacccctggggcccgggaatcccggtcaccgtctccccagcttccaccaagggcccatcggtcttccccctggcgccctgctccaggagcacctctgggggcacagcggccctgggctgcctggtcaaggactacttcctatacgatcg

SEQ ID NO: 460116 - DNA, 491 bp, Homo sapiens; identical to SEQ ID NO: 444592
  misc_feature: HEFZJCU01CHLGX.11.26.C04.1.454.heavy.3.raw

SEQ ID NO: 460117 - DNA, 426 bp, Homo sapiens; identical to SEQ ID NO: 451952
  misc_feature: HEFZJCU01AEIAU.9.34.D01.1.454.heavy.3.raw

SEQ ID NO: 460118 - DNA, 507 bp, Homo sapiens
  misc_feature: HEFZJCU01ENL5N.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgttgttttggccggtgaactactgggccagggcaccctggtcaccgtctcctcagcttccaccaagggccatcggtcttcccctggcgccctgctccaggagcacctctgggggcacagccggccctgggctgcctggtcaggactactccatac

SEQ ID NO: 460119 - DNA, 539 bp, Homo sapiens
  misc_feature: HEFZJCU01AGSXG.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaaagtatggctgtgtttagttggggccaggggagcccgtggtctaccg

SEQ ID NO: 460120 - DNA, 490 bp, Homo sapiens; identical to SEQ ID NO: 456449
  misc_feature: HEFZJCU01DGZ8F.11.38.D05.1.454.heavy.3.raw

SEQ ID NO: 460121 - DNA, 514 bp, Homo sapiens
  misc_feature: HEFZJCU01DM198.19.85.H08.1.454.heavy.3.raw
tactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtctgggggaggcttggttcagcctggagggtccctgagagtctcctgcacagcctctggattcaccttcagtaactatgagatggactggatccgccaggctccaggaaaggggctggagtggattgcctatgtcactagtgagggcgaagtcacgtcctacgcggactctgtgcggggccggtttaccgatctccagagacaatgccaagaagacgctctttctgcaattgacggcctgagagtcgaagacacggctatttattactgtgtgagagaggggggcgacgtggctggtcgggtcggatcttttgt

SEQ ID NO: 460122 - DNA, 501 bp, Homo sapiens
  misc_feature: HEFZJCU01E1N31.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttccccctggcgccctgctccaggagcacctccgagagcacagcggccctgggctgcctggtcaaggactacttccga

SEQ ID NO: 460123 - DNA, 502 bp, Homo sapiens; identical to SEQ ID NO: 450016
  misc_feature: HEFZJCU01D95LD.17.10.A10.1.454.heavy.3.raw

SEQ ID NO: 460124 - DNA, 518 bp, Homo sapiens
  misc_feature: HEFZJCU01B9M4R.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttccccctggcaccctcctccaagagcacctctgggggcacagcgccctgggctgcctggtcaggactacttcctagagacacg

SEQ ID NO: 460125 - DNA, 427 bp, Homo sapiens; identical to SEQ ID NO: 444708
  misc_feature: HEFZJCU01B7MJU.9.34.D01.1.454.heavy.3.raw

SEQ ID NO: 460126 - DNA, 490 bp, Homo sapiens; identical to SEQ ID NO: 445139
  misc_feature: HEFZJCU01A31QJ.12.75.G09.1.454.heavy.3.raw

SEQ ID NO: 460127 - DNA, 519 bp, Homo sapiens
  misc_feature: HEFZJCU01EEIFB.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctcgtggggcacagcgccctgggctgcctggtcaaggactactccgagtagtactac

SEQ ID NO: 460128 - DNA, 512 bp, Homo sapiens
  misc_feature: HEFZJCU01A3Y07.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatggggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggccatcggtcttcccctggcgcctgctccaggagcacctcgtggggcacagcggccg

SEQ ID NO: 460129 - DNA, 535 bp, Homo sapiens
  misc_feature: HEFZJCU01EWPRM.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgttacgagagcgtcgtctgtcagtggaattgactactgggccagggaaccctggtcaccgtctcctcagcctccaccaaggcccg

SEQ ID NO: 460130 - DNA, 504 bp, Homo sapiens
  misc_feature: HEFZJCU01DZQ1Y.48.44.D11.1.454.heavy.3.raw
agtatacatacacgaccggtgctcgatttagcgcagtacgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagacaaacctaataatacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttccccctggcgccctgctccaggagcacctccgagagcacagcggccctgggctgcctggtcaaggactacttcctatgtatact

SEQ ID NO: 460131 - DNA, 427 bp, Homo sapiens; identical to SEQ ID NO: 449549
  misc_feature: HEFZJCU01BHBJN.11.26.C04.1.454.heavy.3.raw

SEQ ID NO: 460132 - DNA, 488 bp, Homo sapiens
  misc_feature: HEFZJCU01A3A32.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctctcagcctccaccaagggcccatcggtcttcccctggcgccctgctccaggagcacctccgagagcacagcggccctgggctgcctggtcaaggactacttcctacgtgagct

SEQ ID NO: 460133 - DNA, 528 bp, Homo sapiens; identical to SEQ ID NO: 450273
  misc_feature: HEFZJCU01EIIYQ.4.59.F04.1.454.heavy.3.raw

SEQ ID NO: 460134 - DNA, 497 bp, Homo sapiens
  misc_feature: HEFZJCU01DORZZ.49.30.C08.1.454.heavy.3.raw
agtcgagagacacgaccggtgctcgatttagtctgacgtcaaagggaaaggggacccaacaaccacatccctcctcagaagcccccagagcacaacgcctcaccatggactggacctggaggatcctctttttggtggcagcagccacaggtgcccactcccaggtccagcttgtgcagtctggggctgaggcgaagaagcctggggcctcagtgaaggtttcctgccaggcttctggatacaccctcagtacccatgctatccattgggtgcgccaggcccccggacaaagacttgagtggatgggatggatcagcgctggcaatggtgacagacactattcacagaagttccagggcagagtcaccatcaccagggacacatccgcgagcacagcctacatggaactgagcagcctgagatctgaagacacgggtgtatattactgtagcgagagggaagtgggatagttgtagatgcgccaggtcgcccggccc

SEQ ID NO: 460135 - DNA, 489 bp, Homo sapiens
  misc_feature: HEFZJCU01C2GH4.51.52.E08.1.454.heavy.3.raw
  modified_base (478)..(478): a, c, t, g, unknown or other
cgatcgtatacacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagcctggggcctcagtgaaggtctcctgcaagacttctggatacaccttcaccgactactatatgcactgggtgcgacaggcccctggacaagggcttgagtggatgggatggatcgaccctaagaatggtgccacaaactatgcacagactttcagggctgggtcaccatgaccagcgacacatctagcaacacagtctacatggagttgaccagcctgaccgacacggccgtgtatttttgtgtgagagattttcggacaatccanagacccctgtc

SEQ ID NO: 460136 - DNA, 521 bp, Homo sapiens
  misc_feature: HEFZJCU01DRO2Z.4.21.B10.1.454.heavy.3.raw
agcactgtagcacgaccggtgctcgatttagtgtcgtcgcaaggggtagaagcctttgaccaggcaggtcaggctgacctggttcttggtcatctcctcccgggatgggggcagggtgtacacctgtggttctcggggctgccctttggttttggagatggttttctcgatgggggctgagctggattttccttttggctattttcaaaggtgtccagtgtggagtgcagctggtggagtctgggggaggcttggtacagcctggcaggtccctgagactctcctgtgcagtctctggattcacgtttggtgaatatgccatgcactgggtccggcaagctccagggaagggcctggagtgggtctcaggtattcgttgggatggtggaaccacaggctatgcggactctgtgaagggccgattcaccatctccagagacaacgccaagaactccctgtttctgcaaatggacagtctgagagctgaggacacggccttgtattactgtagtaaaaggacg

SEQ ID NO: 460137 - DNA, 489 bp, Homo sapiens; identical to SEQ ID NO: 444591
  misc_feature: HEFZJCU01ANZ0M.18.70.G04.1.454.heavy.3.raw

SEQ ID NO: 460138 - DNA, 525 bp, Homo sapiens
  misc_feature: HEFZJCU01DF88F.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggtacggttttggggcgcggactcctcttgagatcgtggggccgaggggacaagtggtcaccgtctcttcagt

SEQ ID NO: 460139 - DNA, 519 bp, Homo sapiens; identical to SEQ ID NO: 445617
  misc_feature: HEFZJCU01A23DI.9.34.D01.1.454.heavy.3.raw

SEQ ID NO: 460140 - DNA, 506 bp, Homo sapiens
  misc_feature: HEFZJCU01CG45Z.18.39.D06.1.454.heavy.3.raw
  modified_base (453)..(453): a, c, t, g, unknown or other
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggtgaactactggggccagggcaccctggtcaccgtctcctcagcttccaccaaggccatcggtcttcccctggcgccctgctccaggngcacctccgagacggccctggctgcctggtcaaggctacttcccatactcgta

SEQ ID NO: 460141 - DNA, 489 bp, Homo sapiens; identical to SEQ ID NO: 454883
  misc_feature: HEFZJCU01DQPV4.10.71.G05.1.454.heavy.3.raw

SEQ ID NO: 460142 - DNA, 492 bp, Homo sapiens
  misc_feature: HEFZJCU01BLPJY.53.26.C04.1.454.heavy.3.raw
cgcgtatacacacgaccggtgctcgatttagtctagcgactttgggtttgggggagcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcagggcaggggtctccatgaccagggacagggccatcagaacagcctacatggagctgaacagactgacatctgacgacacggcgtttattattgtgtgagagaggacccgatgacctc

SEQ ID NO: 460143 - DNA, 511 bp, Homo sapiens; identical to SEQ ID NO: 454334
  misc_feature: HEFZJCU01DDTJM.2.16.B05.1.454.heavy.3.raw

SEQ ID NO: 460144 - DNA, 500 bp, Homo sapiens
  misc_feature: HEFZJCU01CNPSM.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagcgtggttttctcgtagctctttaagaggtgtccagtgtcaagtgcaactggtggagtctggggggggctggtccagcctgggaggtccctgagactctcctgtgcaggctctggattcacttcagtaactacggcgtgcactgggtccgccaggctccaggcaagggcttggagtggctggcagttgtttcatctgaaggagtgttcaatactatacagactccgtgaagggccgattcaccatctccagagacaattccaagaacacgatgtatctgcaaatggacagcctaagagttgaggacacggctgtttattactgtacgaaagagggggatacagtgcagctccaagacttac

SEQ ID NO: 460145 - DNA, 396 bp, Homo sapiens; identical to SEQ ID NO: 444469
  misc_feature: HEFZJCU01ATW8S.47.46.E02.1.454.heavy.3.raw

SEQ ID NO: 460146 - DNA, 544 bp, Homo sapiens
  misc_feature: HEFZJCU01EA5ME.48.3.A03.1.454.heavy.3.raw
agtatacatacacgaccggtgctcgatttagagagcgtcacaggggagctctgagagaggagcccagccctgggattttcaggtgttttcacttggtgatcaggactgaacagagagaactcaccatggagtttgggctgagctggctttttcttctggccattttaaaaggtgtccagtgtgaggagcagttgtcggaatctgggggagacctggtacagccgggggggtccctgacactctcctgtgtggcctctggattcatttttagcaaccacgccattacctgggtccgccagagtccagggaagggactggacggagtcgcgggtataagtggttttagtggaagtagattatacgcagagtccgtaaggggccggttcaccatctccagagacaattccaagaacacggcatatctacaaatgaacaacctgggcgccgaagacacggccgtctattactgtgcgagatcctctactagtgccgcgaggtctttgaactcgtggggtcagggaaccctggtcaccgtctcctcacg

SEQ ID NO: 460147 - DNA, 384 bp, Homo sapiens; identical to SEQ ID NO: 444454
  misc_feature: HEFZJCU01A8WJ5.11.61.F06.1.454.heavy.3.raw

SEQ ID NO: 460148 - DNA, 520 bp, Homo sapiens
  misc_feature: HEFZJCU01APHBO.53.57.F02.1.454.heavy.3.raw
cgcgtatacacacgaccggtgctcgatttagctcgatatagttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctggattcaccttcagggtctatgacatgcactgggtccgccaggctccaggcaaggggctggagtgggtggcagttatatcaaatgatggaagtaagaaatactatgtagactccgtgaagggccgattcaccatctccagagacaattccaagaatacgctgtatctgcacatgaacagcctgagagccgaagacacgggtgtttattactgtgcgaacttattacggaggacaacggtaaccccgcgcacggtacggtacg

SEQ ID NO: 460149 - DNA, 492 bp, Homo sapiens
  misc_feature: HEFZJCU01CPOP8.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaacgggcccatcggtcttcccctggccgccctgctccaggagcacctccgagagcacagcggccctgggctgcctggtcaaggactactcccacgagagta

SEQ ID NO: 460150 - DNA, 508 bp, Homo sapiens
  misc_feature: HEFZJCU01C8J20.22.82.H05.1.454.heavy.3.raw
acatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgcgttttctaggtggctattttaaaacgtgtccagtgtgaggtgcagctggcggagtctgggggaggcctggtacagccgggggggtccctgagactctcctgtgtagcctccggattcacctttagcagacatggcatgagctgggtccgccaggctccagggaaggggccggagtgggtgtcagtcattagtagtagtggtgatagaatttaccacacagactccgtgaagggccgcttcaccatctctagagacaattcccagaacacactgtatctgcaaatgactaggctgagagccgacgacacggccatttatactgcgcgaaggatatacgggtcgacaacggtgctacgcgttt

SEQ ID NO: 460151 - DNA, 537 bp, Homo sapiens
  misc_feature: HEFZJCU01B6SS0.17.28.C06.1.454.heavy.3.raw
  modified_base (486)..(486): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgnggaaaaagtaatggctgtgtttattggggccaggggagccctggtctaccg

SEQ ID NO: 460152 - DNA, 492 bp, Homo sapiens
  misc_feature: HEFZJCU01CKRRH.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaagggaggtatagcagctactggtacgactactggggccagggaaccctggtcaccgtctcctcagcctccaccaagggcccatcggtcttcccctggcgccctgctccaggagcacctccgagagcacagcggccctgggctgcctggtcaaggactacttcccacgagagta

SEQ ID NO: 460153 - DNA, 506 bp, Homo sapiens
  misc_feature: HEFZJCU01EYCSJ.13.37.D04.1.454.heavy.3.raw
tcacgtactacacgaccggtgctcgatttagtagcatactgttgggtttgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattgtaatgatggtagctgctactacactttttgactactggggccagggaaccctggtcaccgtctcttcagcctccaccaagggcccatcggtcttcccctggcaccctcctccaagagcacctctgggggcacagcggccctgggctgcctggtcaaggactacttcctagtacgcga

SEQ ID NO: 460154 - DNA, 466 bp, Homo sapiens
  misc_feature: HEFZJCU01DGIX7.48.7.A07.1.454.heavy.3.raw
agtatacatacacgaccggtgctcgatttagcacgtgtcgcaggggcagggtgtacacctgtggttctcggggctgtcctttggttttggagatggttttctcgatgggggctgggatggctcaacgctgacgatggtcaaacaaaatattcacagcaattccagggcagactctcccttaccagggacacttccgcgaacacaggctacatgtttttgagcagactgacatctaaagacacggctatttactactgtgcgagaggcggattttgtcggcgtggtgattgttacagtcagaatcgtcgattgtggttcgacccctggggccagggaaccctgctctccgtctcctcagcttccaccaagggcccatcggtcttccccctggcgccctgctccaggagcacctctgggggcacagcggccctgggctgcctggtcaaggacacttcctatgtatact

SEQ ID NO: 460155 - DNA, 520 bp, Homo sapiens
  misc_feature: HEFZJCU01CWYXN.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggacggttttggggcgcggactcctcttgagatctggggccaggggacaatggtcaccgtctcttcag

SEQ ID NO: 460156 - DNA, 510 bp, Homo sapiens
  misc_feature: HEFZJCU01A6VKP.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttcttcaaatgaacagcctgagagccgatgacacggtcgtgtattactgtgcgagagatggggcccacgaacgttactacgctatggacgtctgggg

SEQ ID NO: 460157 - DNA, 524 bp, Homo sapiens
  misc_feature: HEFZJCU01CGV6U.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggttctacttcgatctctgggccgtc

SEQ ID NO: 460158 - DNA, 498 bp, Homo sapiens
  misc_feature: HEFZJCU01C7HRZ.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtgggccaagggacaatggtcaccgtctt

SEQ ID NO: 460159 - DNA, 513 bp, Homo sapiens
  misc_feature: HEFZJCU01EETY8.48.53.E09.1.454.heavy.3.raw
agtatacatacacgaccggtgctcgatttagagagagtgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggcctcgggctcgcctggtcaacggactactt

SEQ ID NO: 460160 - DNA, 502 bp, Homo sapiens
  misc_feature: HEFZJCU01DYSR2.26.37.D04.1.454.heavy.3.raw
agactatactcacgaccggtgctcgatttagtagcatactgttgggtttggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggagcaggtagtggagtctgggggaggcgtggtccagcctggggggtccctgagactctcctgtgcagcctctggattcaccttcagtacctacgccatgcactggatccgccaggctccaggcaaggggctagagtgggtggctcttatatcatatgatggaagtaatgaacattacgcagactccgtgaagggccgattcaccgtctccagagacaattccaagagcacgatgtttctgcaaatgaacagcctgagagttgaggacacgggtgtctatttctgtgcgcgagtccgggtgaggggtgtcc

SEQ ID NO: 460161 - DNA, 391 bp, Homo sapiens
  misc_feature: HEFZJCU01AJY9L.5.70.G04.1.454.heavy.3.raw
atcagacacgcacgaccggtgctcgatttagtgtagtgtgaagggaaagggcctggagtgggtctcaggtattacttggaatagtggtgacataggctatgcggactctgtgaagggccgcttcaccatctccagagacaacgccaagaactccctgtatctacaaatgaacagtctgagagttgaggacacggccttctattactgtgcaaaagatcgggacgaagtggtggtggctgcaatcgactactgggcctgggaaccctggtcaccgtctcctcagcctccaccaagggcccatcggtcttccccctggcaccctcctccaagagcacctctgggggcacagcggccctgggctgcctggtcaaggactacttccgtgtctgat

SEQ ID NO: 460162 - DNA, 510 bp, Homo sapiens
  misc_feature: HEFZJCU01BQ6U0.40.81.H04.1.454.heavy.3.raw
tctagcgactcacgaccggtgctcgatttagtagtgtagattcgcggggatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcgggactgacctctgacgacacggccatgtattactgtggaagagacgttggtggctaccgcgggggctggaccactggggccaggggaaccccg

SEQ ID NO: 460163 - DNA, 512 bp, Homo sapiens
  misc_feature: HEFZJCU01CWN17.8.34.D01.1.454.heavy.3.raw
ctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggtccgattcaccatctccagagacaattccaggaacacaatgtatttggagctgaacagcctaagtcctgaggacacgggcgtatactactgtacgaaggaggggggaaccaggcgggagttccaagtactcctttg

SEQ ID NO: 460164 - DNA, 488 bp, Homo sapiens; identical to SEQ ID NO: 447495
  misc_feature: HEFZJCU01ELFPE.22.86.H09.1.454.heavy.3.raw

SEQ ID NO: 460165 - DNA, 550 bp, Homo sapiens
  misc_feature: HEFZJCU01DYEXD.18.59.F04.1.454.heavy.3.raw
tacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccggggggtcccttagactcccctgtacagcctctggattcactttcagtaaggcctggatgaactgggtccgccaggctccagggaaggggctggagtgggttggccgtattaaaaccaaactgatggtgggacaacagactacgctgcacccgtgaaaggcagattcaccatctcaagagatgattcaaaaagcaacgctgtatctgcaaatgaacagcctgagaaccgaggacacagccgtgtattactgtaccacactccctgaaaggcgtacaactactactactaacggtatggaacctcgtcggggtccaagggaacccg

SEQ ID NO: 460166 - DNA, 503 bp, Homo sapiens; identical to SEQ ID NO: 449299
  misc_feature: HEFZJCU01DL3ED.53.54.E10.1.454.heavy.3.raw

SEQ ID NO: 460167 - DNA, 510 bp, Homo sapiens
  misc_feature: HEFZJCU01C6YG3.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaaccctccaccggcacagcctacatggagctgagcagtctgacacctgacgacacggccgtctattactgtgcgagagccgcgaatatgtggtgcaaagatggtcgttgttgttttggccggtgaactactggggccagggcaccctggtcaccgtctcctcagcttccaccaagggccccatcggtcttcccctggcgccctgctccaggagcacctctgggggcacagcggccctgggcctgcctggtcaaggactactcccata

SEQ ID NO: 460168 - DNA, 395 bp, Homo sapiens; identical to SEQ ID NO: 444517
  misc_feature: HEFZJCU01DEU11.16.68.G02.1.454.heavy.3.raw

SEQ ID NO: 460169 - DNA, 502 bp, Homo sapiens
  misc_feature: HEFZJCU01AG6FQ.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgttctgcaatgaacagcctgagaattgaggactcgggtatatactactgtgcccgtgaccccctgactgataaaccggactggttccgaccctcggggccgagggaacccgtggtcaccgtctcctc

SEQ ID NO: 460170 - DNA, 505 bp, Homo sapiens
  misc_feature: HEFZJCU01DAQQQ.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttccccctggcaccctcctccaagagcacctctgggggcacagcggccctgggctgcctggtcaaggctacttcctacgtcgtat

SEQ ID NO: 460171 - DNA, 481 bp, Homo sapiens; identical to SEQ ID NO: 448054
  misc_feature: HEFZJCU01CK481.22.36.D03.1.454.heavy.3.raw

SEQ ID NO: 460172 - DNA, 503 bp, Homo sapiens
  misc_feature: HEFZJCU01BUHN3.10.23.C01.1.454.heavy.3.raw
catagtagtgcacgaccggtgctcgatttagtacacgtgattagggattgggaggcttggtacagcctggcaggtccccgagactctcctgtgcagcctctggattcagctttgatgaatatgccatggactgggtccggcaagttccagggaagggcctggagtgggtctcaggtattgattggaatagtggtaccattgcctatgcggactctgtgaagggccgattcaccatcaccagagacgacgccaggagctccctgtatctccaaatgaacagtctgagacctgaggacacggccttgtattactgtgtaagagggagtcagggtttcaactattatagtagtggttatgactactggggccagggaaccctggtcaccgtctcctcagcctccaccaagggcccatcggtcttcccctggcgccctgctccaggagcacctccgagagcacagcggccctgggctgcctggtcaaggactactcccactactatg

SEQ ID NO: 460173 - DNA, 509 bp, Homo sapiens; identical to SEQ ID NO: 447939
  misc_feature: HEFZJCU01A00CG.17.25.C03.1.454.heavy.3.raw

SEQ ID NO: 460174 - DNA, 402 bp, Homo sapiens
  misc_feature: HEFZJCU01D88LI.11.70.G04.1.454.heavy.3.raw
cgagagataccacgaccggtgctcgatttagtgtagtgtgaagggaaagggactggagtggattggtcatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaaagtaattgttagggacctccactacggtatggacgtctggggccaagggaccacggtcaccgtctcctcagcctccaccaagggcccatcggtcctccccctggcaccctcctccaagagcacctctgggggcacagcggccctgggctgcctggtcaaggactacttccgtatctctcg

SEQ ID NO: 460175 - DNA, 497 bp, Homo sapiens; identical to SEQ ID NO: 458817
  misc_feature: HEFZJCU01BRXP4.53.4.A04.1.454.heavy.3.raw

SEQ ID NO: 460176 - DNA, 495 bp, Homo sapiens
  misc_feature: HEFZJCU01DFNCY.12.55.E11.1.454.heavy.3.raw
atacgacgtacacgaccggtgctcgatttagcactcgcacgttgggtttgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtattttcgatctctggggcctggcaccctggtcactgtctcctcggcttccaccaagggcccatcggtcttcccctgcgccctgctccaggagcacctctgggggcacagcggccctgggctgcctggtcaggactacttcctacgtcgtat

SEQ ID NO: 460177 - DNA, 379 bp, Homo sapiens; identical to SEQ ID NO: 444450
  misc_feature: HEFZJCU01EN9S3.47.77.G11.1.454.heavy.3.raw

SEQ ID NO: 460178 - DNA, 489 bp, Homo sapiens
  misc_feature: HEFZJCU01B7N30.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctgcgccctgctccaggagcacctccgagagcacagcgccctcgggctcgcctggtcaaggactacttcccatactcgta

SEQ ID NO: 460179 - DNA, 502 bp, Homo sapiens
  misc_feature: HEFZJCU01ESSGD.11.27.C05.1.454.heavy.3.raw
cgagagataccacgaccggtgctcgatttagacgcgatcgaagggtttgggggagagaggagccttagccctgggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagaggagctattatctcggaaccccgat

SEQ ID NO: 460180 - DNA, 495 bp, Homo sapiens
  misc_feature: HEFZJCU01DHTUK.14.25.C03.1.454.heavy.3.raw
cgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgt

SEQ ID NO: 460181 - DNA, 491 bp, Homo sapiens
  misc_feature: HEFZJCU01CKXA1.4.28.C06.1.454.heavy.3.raw
agcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgaggggccgattcaccatcttcagagacaacgccaaggacacgctgtatctggaaatgagcagtctgagagccgaggacacggctgtgtattactgtgcaagagataacggacttggtacgccctttgactactggggcccggggacctggtcaccgtctcctcggcctccaccaagggcccatcggtcttcccctggcgccctgctccaggagcacctccgagagcacagcggccctgggctgcctggtcaaggactacttccctacagtgct

SEQ ID NO: 460182 - DNA, 400 bp, Homo sapiens; identical to SEQ ID NO: 444452
  misc_feature: HEFZJCU01BIS3C.47.24.C02.1.454.heavy.3.raw

SEQ ID NO: 460183 - DNA, 509 bp, Homo sapiens
  misc_feature: HEFZJCU01D1XLJ.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggtgaactactgggccagggcacctggtcaccgtctcctcagcttccaccaagggcccatcggtcttcccctggcgcctgctccaggagcacctctggggcacagcggccctcgggctgccgtggtcaacggactacttcccata

SEQ ID NO: 460184 - DNA, 403 bp, Homo sapiens; identical to SEQ ID NO: 444540
  misc_feature: HEFZJCU01DPXIS.16.72.G06.1.454.heavy.3.raw

SEQ ID NO: 460185 - DNA, 533 bp, Homo sapiens
  misc_feature: HEFZJCU01E2QVI.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccactaggttttgactactgggggccgaggggaaggcgttggttcgtaccgtcctccctccacgcct

SEQ ID NO: 460186 - DNA, 506 bp, Homo sapiens
  misc_feature: HEFZJCU01BFXF2.21.35.D02.1.454.heavy.3.raw
tcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcacgtgggtccgccagactccaggcaaggggctagagtggctggcagttatcgcattcgatggaagcgatatgtactatgcggactccgtgaagggccgattcaccatctccagagacaattccaagaacacgctgtttctgcaaatgagcagcctgaaagaagaggacacggctgtatataactgtgcgcgaggaccttattattatggttcagggaccattgactactggggccagggaaccctggtcaccgtctcctcagcctccaccg

SEQ ID NO: 460187 - DNA, 324 bp, Homo sapiens; identical to SEQ ID NO: 444475
  misc_feature: HEFZJCU01B00MA.18.17.B06.1.454.heavy.3.raw

SEQ ID NO: 460188 - DNA, 462 bp, Homo sapiens; identical to SEQ ID NO: 444770
  misc_feature: HEFZJCU01EYRG8.40.23.C01.1.454.heavy.3.raw

SEQ ID NO: 460189 - DNA, 389 bp, Homo sapiens; identical to SEQ ID NO: 455198
  misc_feature: HEFZJCU01BF221.52.53.E09.1.454.heavy.3.raw

SEQ ID NO: 460190 - DNA, 516 bp, Homo sapiens
  misc_feature: HEFZJCU01D6ZFG.47.78.H01.1.454.heavy.3.raw
agctcacgtacacgaccggtgctcgatttagtgtgagtagtttgggtttggggctctgggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtctgggggaggcctcataaagccgggggggtcccttaaactctcctgcgcagcgtctggatttcctttcagtcaagtctggataagctgggtccgccaggctccagggatgggcctggagtgggttggccgtgtcaagagcagaactgatggtgcgacatctgaatacgctgcacccgtgaaaggcagattcaccatctccagagatgattcaataaatatgtcatatctacaaatggatagcctgaaaatcgaggatacaggtgtttattactgttccacagggaatgcgttctctggggccgagggac

SEQ ID NO: 460191 - DNA, 545 bp, Homo sapiens
  misc_feature: HEFZJCU01BURI9.40.9.A09.1.454.heavy.3.raw
tctagcgactcacgaccggtgctcgatttagcgagacgcgcagggacagaggactcaccatggaattggggctgagctgggttttccttgttgctattttagaaggtgtccagtgtgcggtgaaactagcggagtctgggggaggcttggtccagcctggggggtccctaagactctcctgcgcagcctctggattcatgtttagtgattattggatggcttgggtccgtcaggctccagggaaagggctggagtttgtggccaagatgaaccacgacggaaatgagaaaaactatgcggactctgtgaagggccgattcaccatttccagagacaattccaagaacacactgaatctacaaatgaacagcctcagacctgaggactcggctgtctatttctgtgcgagagggggtgactatcgatcctttgatttacttgggggccgaggggagcccgtcggtcgaccgtcctcctcagccctccaccaacgggcccatcggtccttcccccgtcggccgccctcgcctccacggagcacctcg

SEQ ID NO: 460192 - DNA, 509 bp, Homo sapiens
  misc_feature: HEFZJCU01APOAS.16.21.B10.1.454.heavy.3.raw
tgtactactccacgaccggtgctcgatttagtgtcgtcgcaggagagaggagcccagccctgggattttcaggtgttttctatttggtgatcaggactgaacagagagaactcaccatggagtctgggctgagctggctttttcttgtggctattttaaaaggtgtccagtgtgaggtgcagctgttggagtctgggggaggcttggacacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactgggg

SEQ ID NO: 460193 - DNA, 510 bp, Homo sapiens
  misc_feature: HEFZJCU01D4U1P.4.25.C03.1.454.heavy.3.raw
agcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgtttctgcaaatgaacagcctgagagccgaggacacggctgtgtatcactgtgtcagagatgccgagggcggttacccctctggttccttcgacagttatggtatggacgtctggggcctagggactacggtcaccgtctcctcagcctccaccaagggcccatcggtcttccccct

SEQ ID NO: 460194 - DNA, 499 bp, Homo sapiens
  misc_feature: HEFZJCU01D7JME.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgacgaagatttctatagaggtgacgtacgggggcgttcg

SEQ ID NO: 460195 - DNA, 506 bp, Homo sapiens
  misc_feature: HEFZJCU01DRAXF.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgttcatctgagggcagtgttcaatggtatgcagactccgtgaagggccgattcaccatctccagagacaattccaggaacacaatgtatttggagctgaacagacctaagtcctgaggacgacggcgtatactactgtacgaaggaggggggaacgaggcggagtcaagtactctt

SEQ ID NO: 460196 - DNA, 535 bp, Homo sapiens
  misc_feature: HEFZJCU01ENCU6.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtccaccgtctcctcagccctccaccaacggg

SEQ ID NO: 460197 - DNA, 528 bp, Homo sapiens
  misc_feature: HEFZJCU01CEEK0.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgatttcaccatctccagagacaattacaagaacaccctttatctgcaaatagacagcctgagaccagacgacacggctgtctattattgcgcgagagagacgacacgaacctactggccaatactatgggggcttggttctggggccaggggaccctggtcatcgtctccccacgcctccaccaaggggcccatcggtcttccccctggtcg

SEQ ID NO: 460198 - DNA, 518 bp, Homo sapiens
  misc_feature: HEFZJCU01BC7NB.48.45.E01.1.454.heavy.3.raw
agtatacatacacgaccggtgctcgatttagtgagtcagtaagggaaaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagacctctggatacaccttcacgaactgtgctattcattgggtgcgacaggcccctggacaagggcttgagtggatggggtggatcaacaccaacactgggaacccaacgtatgcccagggcttcacaggacgatttgtcttctccttggacacctctgtcaatacggcacatctgcagatcaccagcctgaagactgaggacactgccgtgtattcttgtgtgagacgaagtagtagctcgccctctttgacttacgtggggccagggaaccctggtccaccggcct

SEQ ID NO: 460199 - DNA, 504 bp, Homo sapiens
  misc_feature: HEFZJCU01CU7ZF.48.23.C01.1.454.heavy.3.raw
  modified_base (434)..(434): a, c, t, g, unknown or other
agtatacatacacgaccggtgctcgatttagtacacgtgattagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattacngtgcgaggccccgagcgcagtggctttttgatgcctttgatatgtggggccaagggacaatggtcaccgt

SEQ ID NO: 460200 - DNA, 513 bp, Homo sapiens
  misc_feature: HEFZJCU01DHEEB.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtctgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcggggacttctggggccaggggtaacccg

SEQ ID NO: 460201 - DNA, 519 bp, Homo sapiens
  misc_feature: HEFZJCU01BIS5Z.51.62.F07.1.454.heavy.3.raw
cgatcgtatacacgaccggtgctcgatttagtagtcgcataaagggaaagggggcatcacataacaaccagattcctcctctaaagaagcccctgggagcacagttcatcaccatggactggacctggaagttcctctttgtggtggcagcagcaacaggtgtccagtcgcaggtccagctggtgcagtctgggactgaggtgaagaggcctgggtcctcggtgaaggtctcctgcaaggcatctaaaaacatcttaagaagttatgacatcgcctgggtgcgacaggcccctggacatgggcttgagtgggtgggcgaggatcatccctatgtttggagtcgcaaactacgcacagaagttccggggcaaagtcacgttgaccgcggacacagtcacggacacagcctacatggaactcaatggcctcagatttgaggacacggccgtctattattgtgcgagagtgagaaattacggtggctactcccttgactactgggccagggaaccctggtcc

SEQ ID NO: 460202 - DNA, 368 bp, Homo sapiens; identical to SEQ ID NO: 449414
  misc_feature: HEFZJCU01AV6Y5.19.53.E09.1.454.heavy.3.raw

SEQ ID NO: 460203 - DNA, 498 bp, Homo sapiens
  misc_feature: HEFZJCU01D5HBM.22.5.A05.1.454.heavy.3.raw
acatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcagcccccaggaaaggccctagactggcttgcactcatttattggaatgatgataagcgctacagcccatctctgaagagcagactcaacatcaccaaggacacctccaaaaagcaagtggtccttacaatgaccaacatggaccctttggacacagccacatattactgtgcacaccacagggtctctactgctggctttcagtacaactggttcgaacctggggccagggaaccctggtcagcgtctcctcagcct

SEQ ID NO: 460204 - DNA, 519 bp, Homo sapiens; identical to SEQ ID NO: 444867
  misc_feature: HEFZJCU01ET5RH.9.34.D01.1.454.heavy.3.raw

SEQ ID NO: 460205 - DNA, 517 bp, Homo sapiens
  misc_feature: HEFZJCU01C3PE1.4.33.C11.1.454.heavy.3.raw
agcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatgaacagcctgaagaccgaggacacagccgtctattactgtgttagggtagttttacgtatttttggagtggagtattaa

SEQ ID NO: 460206 - DNA, 526 bp, Homo sapiens
  misc_feature: HEFZJCU01D9MDA.48.33.C11.1.454.heavy.3.raw
agtatacatacacgaccggtgctcgatttagagtgagctcgttgggtttggggagtgactcctgtgccccaccatggacacactttgctccacgctcctgctgctgaccatcccttcatgggtcttgtcccagatcaccttgaaggagtctgggccaacgctggtgaaacccacacagaccctcacgctgacctgcaccttctctgggttctcactcaccactgatgaggtgggtgtggcctggatccgtcagcccccgggaaaggccccggagtggcttggattgatttatggggatggtgacaagcgttacagtgcatctctgaagaccagactctccatcaccaaggacacctccaagaacgaggttgtcctttccttggccaacatgcaccctgtggacacggccacttatttttgttacacacaccatcttgacgactggggatgcttttcatttctggggccaggggaccgtggtcgccgtgtctacagcctccaccaagggcccatcggtcttcccctc

SEQ ID NO: 460207 - DNA, 484 bp, Homo sapiens
  misc_feature: HEFZJCU01CIM5G.52.6.A06.1.454.heavy.3.raw
cgcagtacgacacgaccggtgctcgatttagatctactgacaggggctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctggggggggctggtccagcctgggaggtccctgagactctcctgtgcaggctctgcatttcccttcagtaactatgctatcgattgggtccgccaggctccaggcaagggctggagtgggtggcagttatatcagctgatggaggcaataagtattacgcagattctgcgaggggccgattcaccatatccagagacaactcccaagatatgatatatctgcaaatgaacagcctgagacctgaggacacggccatatattattgtgcgtcagggggcagtgcctc

SEQ ID NO: 460208 - DNA, 526 bp, Homo sapiens
  misc_feature: HEFZJCU01BRBGW.9.34.D01.1.454.heavy.3.raw
tgatacgtctcacgaccggtgctcgatttagatcgtctgtgttgggtttgggcatgtgtgagttttgtcacaagatttgggctcaactttcttgtccaccttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggccaccctcctccaagagcacctctgggggcacagcggcccg

SEQ ID NO: 460209 - DNA, 518 bp, Homo sapiens; identical to SEQ ID NO: 451556
  misc_feature: HEFZJCU01B7HEQ.13.76.G10.1.454.heavy.3.raw

SEQ ID NO: 460210 - DNA, 458 bp, Homo sapiens
  misc_feature: HEFZJCU01DHWYC.53.12.B01.1.454.heavy.3.raw
cgcgtatacacacgaccggtgctcgatttagtagtgtagattccgcgggcaccttgaccaactactatttacagtggttgcgacaggtccctggacaagggcttgagtggatgggaagaatcaaccctaatgatggaagtgcaacaaatgcgctgaaatttcagggcagaataaccctgaccagggacacgtccacgagcacagtctacatggaattgagcagcctaacatctgaagacacggccgtctattactgtgcgagagaatatcgttttatagtgggagctgccccaagatcgccattccactttgactactggggccagggaacactggtcaccgtctcctcagcctccaccaagggcccatcggtcttcccctggcaccctcctccaagagcacctctggggcacagcggccctgggctgcctggtcaaggactacttcctcgtactgcg

SEQ ID NO: 460211 - DNA, 481 bp, Homo sapiens
  misc_feature: HEFZJCU01DM48U.19.67.G01.1.454.heavy.3.raw
tactctcgtgcacgaccggtgctcgatttagagtatacatattgggcttggtccagcctgggcggtcgtctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctggtggacagatcactggggccagggaaccctggtcaccgtctcctcagcctccaccaagggcccatcggtcttcccctggcgccctgctccaggagcacctccgagagcacagcggccctgggctgcctggtcaaggactacttcccacgagagta

SEQ ID NO: 460212 - DNA, 521 bp, Homo sapiens
  misc_feature: HEFZJCU01DLPA9.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttcccctggcaccctcctccaagagcacctctgggggcacagcggccctgggctcgcctggtcaaggactacttccgagtagtactac

SEQ ID NO: 460213 - DNA, 509 bp, Homo sapiens
  misc_feature: HEFZJCU01CNDNR.22.82.H05.1.454.heavy.3.raw
  modified_base (453)..(453): a, c, t, g, unknown or other
acatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggcttttcttgtggctattttaaaacgtgtccagtgtgaggtgcagctggcggagtctgggggaggcctggtacagccgggggggtccctgagactctcctgtgtagcctccggattcacctttagcagacatggcatgagctgggtccgccaggctccagggaaggggccggagtgggtgtcagtcattagtagtagtggtgatagaatttaccacacagactccgtgaagggccgcttcaccatctctagagacaattcccagaacacactgtatctgcaaatgactaggctgagagcccgacgacncggccatttattactgcgcgaaggatatacgggtcgaacaacggtggctacgcttt

SEQ ID NO: 460214 - DNA, 531 bp, Homo sapiens
  misc_feature: HEFZJCU01DPJTF.7.78.H01.1.454.heavy.3.raw
  modified_base (505)..(505): a, c, t, g, unknown or other
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaacttcaacctgacgacactgccgtttattttgtacgagagcgtcgtctgtcagtggaattgactactgggccagggaaccctggtacncgtctcctcacgcctccacctaaggg

SEQ ID NO: 460215 - DNA, 537 bp, Homo sapiens
  misc_feature: HEFZJCU01BY6QJ.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgctggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaagggcccatccggtcttccccctcggcaccctcctccaagagcacctctgggggcaca

SEQ ID NO: 460216 - DNA, 384 bp, Homo sapiens; identical to SEQ ID NO: 444454
  misc_feature: HEFZJCU01EC3YM.11.61.F06.1.454.heavy.3.raw

SEQ ID NO: 460217 - DNA, 529 bp, Homo sapiens
  misc_feature: HEFZJCU01BYXSC.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttggggccagggaaccctggtcaccgtctcctcagcctccaccaagggcccatcggtcttccccctggcaccctcctccaagagcacctctgggggcacagcggccctgggctg

SEQ ID NO: 460218 - DNA, 504 bp, Homo sapiens
  misc_feature: HEFZJCU01AU1YP.48.44.D11.1.454.heavy.3.raw
agtatacatacacgaccggtgctcgatttagcgcagtacgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaacctaataattacgcgacagcatttgctgcgtcggtgagaggcaggttcaccctctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggactacttcctatgtatact

SEQ ID NO: 460219 - DNA, 504 bp, Homo sapiens
  misc_feature: HEFZJCU01DX5KO.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgactttcgtggggccg

SEQ ID NO: 460220 - DNA, 506 bp, Homo sapiens
  misc_feature: HEFZJCU01D13S0.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatgggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggacg

SEQ ID NO: 460221 - DNA, 388 bp, Homo sapiens
  misc_feature: HEFZJCU01DNVQR.9.63.F08.1.454.heavy.3.raw
tgatacgtctcacgaccggtgctcgatttagcgatcgtataagggctggatcaacccttacaccggtcgcccaaactatgcagcgtcttttcggaacagggtcaccctgacctgggacgcgtcccgcaatacagcctccatggaattgaccacactgaaatctgacgacacggccgtcttactattgtgcgagggtcaatagtcttaccataaacggtgcccggacaggatgattttttggatgtctggggccaaggtacagcggtcaccgtcgcctcagcctccaccaagggcccatcggtcttccccctggcaccctcctccaagagcacctctgggggcacagcggcctgggctgcctggtcaaggactacttccagacgtatca

SEQ ID NO: 460222 - DNA, 499 bp, Homo sapiens
  misc_feature: HEFZJCU01DB23P.48.23.C01.1.454.heavy.3.raw
agtatacatacacgaccggtgctcgatttagtacacgtgattagggattggggacccaacaaccacatccctcctcagaagcccccagagcacaactccgtaccatggactggacctggaggatcctctttttggtggcagcagccacaggtgcccactcccaggtccagcttgtgcaatctgggactgaactgaagaagcccgggggctctgtgagggtttcatgcaaggcctctggatactcgttcacaacctacactatgcattgggtgcgccaggcccccggacaaagccttgagtggatggggtggctcaacgctggcgatggtcagacaaagtattcacagaagttccagggcagagtcaccatcaccagggacacgtccgcgagtagtgtcttcatggagctgcgcagtctgagatcggaagacacggcagtatattactgtgcgagaggcggatattgtcgtcgaggtgactgctacagtcaaaatcgtgt

SEQ ID NO: 460223 - DNA, 467 bp, Homo sapiens; identical to SEQ ID NO: 445004
  misc_feature: HEFZJCU01A73PV.16.78.H01.1.454.heavy.3.raw

SEQ ID NO: 460224 - DNA, 510 bp, Homo sapiens
  misc_feature: HEFZJCU01EMIII.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtggcgttttcttaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacgctgtatttgcaatgaacagtctgagagtcgaggacacggccatatattactgtgcgaagcgggaattggtggcggtgactgctattgactactggggccac

SEQ ID NO: 460225 - DNA, 480 bp, Homo sapiens; identical to SEQ ID NO: 445011
  misc_feature: HEFZJCU01AM5CZ.22.36.D03.1.454.heavy.3.raw

SEQ ID NO: 460226 - DNA, 495 bp, Homo sapiens
  misc_feature: HEFZJCU01CE02U.14.25.C03.1.454.heavy.3.raw
  modified_base (491)..(491): a, c, t, g, unknown or other
cgtctagtaccacgaccggtgctcgatttagtagtgtagatttgggtttgggggggagacgagccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcaacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatnttgt

SEQ ID NO: 460227 - DNA, 375 bp, Homo sapiens
  misc_feature: HEFZJCU01CSA6E.49.61.F06.1.454.heavy.3.raw
agtcgagagacacgaccggtgctcgatttagctacgctctaagggaaaggggctggagtgggtggccaacataaaccaagatggaactgtggaagactacatagactctgtgaagggccgattcaccatctccagagacaacgccaagaattcactgtttctgcacatgagcagtctgagagtcgaggacacggccttctattattgtgtgagtcagagtggcccaacccattggagccagggaaccctagtcagcgtctcctcagcctccaccaagggcccatcggtcttccccctggcgccctgctccaggagcacctccgagagcacagcggccctgggctgcctggtcaaggactacttcctctctcgact

SEQ ID NO: 460228 - DNA, 469 bp, Homo sapiens; identical to SEQ ID NO: 452463
  misc_feature: HEFZJCU01DHM2K.4.36.D03.1.454.heavy.3.raw

SEQ ID NO: 460229 - DNA, 529 bp, Homo sapiens; identical to SEQ ID NO: 446480
  misc_feature: HEFZJCU01AZLBE.18.33.C11.1.454.heavy.3.raw

SEQ ID NO: 460230 - DNA, 497 bp, Homo sapiens
  misc_feature: HEFZJCU01BGCQS.47.38.D05.1.454.heavy.3.raw
agctcacgtacacgaccggtgctcgatttagtatctgatagttgggtttgggggagagcatcacccagcaaccacatctgtcctctagagaatcccctgagagctccgttcctcaccatggactggacctggaggatcctcttcttggtggcagcagccacaggagtccactcccagttgcaactggtgcagtctggggctgaggtgaagaagcctggggcctcagtgaaggtctcctgcaaggcttctggatacagcttcaccgactactatttgcactgggtgcgacgggcccctggacaagggcttgagtggatgggacggatcagccctaacagtggtggcacaaactatgcacagaggtttcagggcaggggtcaccatgaccagggacacgtccatcagtacagcctacatggagctgagcagtctgagacctgacgacacggccgtgtattattgtgcgttagttacggacgattatgacgttttgattt

SEQ ID NO: 460231 - DNA, 482 bp, Homo sapiens; identical to SEQ ID NO: 444503
  misc_feature: HEFZJCU01C2PB1.7.10.A10.1.454.heavy.3.raw

SEQ ID NO: 460232 - DNA, 499 bp, Homo sapiens
  misc_feature: HEFZJCU01CS5Z5.12.55.E11.1.454.heavy.3.raw
atacgacgtacacgaccggtgctcgatttagcactcgcacgttgggtttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggcgcctgctcagagcactctggggcac

SEQ ID NO: 460233 - DNA, 502 bp, Homo sapiens
  misc_feature: HEFZJCU01EHTML.2.33.C11.1.454.heavy.3.raw
acgctcgacacacgaccggtgctcgatttagagtgagctcgttgggtttgggagaggagccccagccttgggattcccaagtgttttcattcagtgatcaggactgaacacagaggactcaccatggactttgggctgaggtggattttccttgctgccattttaaaaggtttccactgtgagctgcgactggtgtcgtctgggggaggcttggtgcagccgggtgggtccctgcgactctcctgtgcaatttctgaagcccttccaatacagtgtggatgaattgggtccgccaggctccagggaaggggctggagtgggttggccatataaaaagtagactgctggtgagacaacagactacgctgctgccttcagaggcagattcaccatcttcagagatgaatcacagagcactctgtttctgcaaatgaacagcctaggaagacgcggacacagccatgtattattagtacattaggacactatacgtccgtgggcc

SEQ ID NO: 460234 - DNA, 516 bp, Homo sapiens
  misc_feature: HEFZJCU01DJZLQ.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactgggccggggaaccctggtcgccgtctcctcagcctccaccaagggcccatcggtcttcccctggcaccctcctccaagagcacctctgggggcacagcggcctgggctgcctggtcaaggactacttccagacgtatca

SEQ ID NO: 460235 - DNA, 479 bp, Homo sapiens; identical to SEQ ID NO: 447128
  misc_feature: HEFZJCU01AQ6K7.4.37.D04.1.454.heavy.3.raw

SEQ ID NO: 460236 - DNA, 536 bp, Homo sapiens; identical to SEQ ID NO: 453623
  misc_feature: HEFZJCU01CV2FR.13.88.H11.1.454.heavy.3.raw

SEQ ID NO: 460237 - DNA, 516 bp, Homo sapiens
  misc_feature: HEFZJCU01BLKDA.52.78.H01.1.454.heavy.3.raw
cgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctgggccgtggcaccctggtcactgtcttctcagcctccaccaagggcccatcggtcttcccctggcaccctcctccaagagcacctctgggggcacagcggccctgggctgcctggtcaaggactacttcctatacg

SEQ ID NO: 460238 - DNA, 507 bp, Homo sapiens; identical to SEQ ID NO: 451341
  misc_feature: HEFZJCU01C4QL2.51.56.F01.1.454.heavy.3.raw

SEQ ID NO: 460239 - DNA, 500 bp, Homo sapiens
  misc_feature: HEFZJCU01BIMN8.11.41.D08.1.454.heavy.3.raw
cgagagataccacgaccggtgctcgatttagtcacgcgagaaagggaaagggtctccgaagccttcggagaccctgtccctcacctgcactgtctctggtgactccatcagtaggtactattggagctggatccggcagcccccagggaagggactggagtggattgggtggatgtattacagtgggagcaccaactacaacccctccctcaagagtcgagtcaccatatcagtagacatgtccaagaaccagtgctccctgaagctgagctctgtgaccgctgcggacacggccgtgtattactgcgcgaaagggggatatagtggctacaatcggccctactacggtatggacgtctggggccaagggaccacggtcaccgtctcctcagcctccaccaagggcccatcggtcttcccctggcaccctcctccaagagcacctctgggggcacagcggccctgggctgcctggtcaaggactacttccgtatctctcg

SEQ ID NO: 460240 - DNA, 514 bp, Homo sapiens
  misc_feature: HEFZJCU01BCYLF.10.53.E09.1.454.heavy.3.raw
catagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcgtcgggggagtacctctagcactc

SEQ ID NO: 460241 - DNA, 510 bp, Homo sapiens
  misc_feature: HEFZJCU01EGWKA.48.34.D01.1.454.heavy.3.raw
agtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctgcgccctgctccaggagcacctccgagagcacagcggccctgggctgcctggtcaaggactactt

SEQ ID NO: 460242 - DNA, 508 bp, Homo sapiens
  misc_feature: HEFZJCU01DKJ6H.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtcctcaagagtcgagtcagcatgtcagtcgacacgtcccagaaccagttctccctgacagtgagttatatgaccgccgcagacacggccgtgtattactgtgcgagagaggccgtttattttaggaccagctagttaaaactcctactacggtctggacgtctggggcc

SEQ ID NO: 460243 - DNA, 505 bp, Homo sapiens
  misc_feature: HEFZJCU01AQSSX.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgatacggccgtctattactgtgcgagagtcccacgatccgggtgagcctacggcagcggcctttgacttcgtc

SEQ ID NO: 460244 - DNA, 322 bp, Homo sapiens; identical to SEQ ID NO: 444440
  misc_feature: HEFZJCU01DTFSS.47.38.D05.1.454.heavy.3.raw

SEQ ID NO: 460245 - DNA, 505 bp, Homo sapiens
  misc_feature: HEFZJCU01BDHE7.3.63.F08.1.454.heavy.3.raw
agacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccagggaaggggctgggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagtttgtttgggcgggtataggcagcggtaccc

SEQ ID NO: 460246 - DNA, 520 bp, Homo sapiens
  misc_feature: HEFZJCU01EAZ9Q.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccgaagggaccg

SEQ ID NO: 460247 - DNA, 500 bp, Homo sapiens; identical to SEQ ID NO: 447911
  misc_feature: HEFZJCU01C18CH.26.23.C01.1.454.heavy.3.raw

SEQ ID NO: 460248 - DNA, 373 bp, Homo sapiens; identical to SEQ ID NO: 445918
  misc_feature: HEFZJCU01EGN1H.49.30.C08.1.454.heavy.3.raw

SEQ ID NO: 460249 - DNA, 466 bp, Homo sapiens
  misc_feature: HEFZJCU01A5VO3.48.7.A07.1.454.heavy.3.raw
agtatacatacacgaccggtgctcgatttagcacgtgtcgcaggggcagggtgtacacctgtggttctcggggctgtcctttggttttggagatggttttctcgatgggggctgggatggctcaacgctgacgatggtcaaacaaaatattcacagcaattccagggcagactctcccttaccagggacacttccgcgaacacaggctacatgtttttgagcagactgacatctaaagacacggctatttactactgtgcgagaggcggattttgtcggcgtggtgattgttacagtcagaatcgtcgattgtggttgacccctggggccagggaaccctgctctccgtctcctcagcttccaccaagggcccatcggtcttccccctggcgccctgctccaggagcacctctgggggcacagcggccctgggctgcctggtcaaggactacttcctatgtatact

SEQ ID NO: 460250 - DNA, 534 bp, Homo sapiens
  misc_feature: HEFZJCU01AP0BU.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataacaaccttcaacctgacgacactgccgtttatttttgtacgagagcgtcgtctgtcagtggaattgactactgggccagggaaccctggtcaccgtctcctcagcctccaccaacgggccc

SEQ ID NO: 460251 - DNA, 527 bp, Homo sapiens
  misc_feature: HEFZJCU01EPMS9.49.51.E07.1.454.heavy.3.raw
agtcgagagacacgaccggtgctcgatttagcatactctacaacacacaaagggggggagaggagccccagcccggagattcccaggtgtttccattcggtgatcagcactgaacacagagaactcaccatggagtttggactgagctgggttttccttgttgccatgttaaaaggtgtccagtgtgaagtgcggctggtggagtctgggggaggcgtggtgcagcctggggggtccctcagactctcctgtgcagcctccaacttcagctttggtgattttaccatgcactgggtccgccaaggtccggggcggggtctggagtgggtcgctcttattagtggagatgaagatggcacctactatgcagattctgtgaagggccggttcaccatctccagagacaacaggaaaagtccctgtatctgcaaatgaacagtctgaggactggagacaccgccttggtatttattgtgtaaaggaatacaaagagtcttacgatggtttggagtgcattattacgtacg

SEQ ID NO: 460252 - DNA, 520 bp, Homo sapiens
  misc_feature: HEFZJCU01CIS6D.8.34.D01.1.454.heavy.3.raw
ctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaagggaggggggaaccaggcgggagtccaagtactccttt

SEQ ID NO: 460253 - DNA, 540 bp, Homo sapiens
  misc_feature: HEFZJCU01ANZ2V.48.28.C06.1.454.heavy.3.raw
agtatacatacacgaccggtgctcgatttagagctcacgtattgggtttgggggaggtgtgtcacaagatttgggctccttcggctggtctggggtgacctctctccgcttcacctggagcattctcaggggctgtcgtgatgattgcgtggtgggactctgtcccgctccaaggcacccgctctctgggacgggtgcccccggggtttttggactcctgggggtgacttagcagccgtctgcttgcagttggacttcccaggccgacagtggtctggcttctgaggggtcaggccagaatgtggggtacgtgggaggccagcagagggttccatgagaagggcaggacagggccatggacagtcagcttccatgtgacgcccggagacagaaggtctctgggtggctgggtttttgtggggtgaggatggacattctgccattgtgattactactactactacggtatggacgtctggggccaagggaccacggtcaccgtctcctcagcttccaccaaggcccatcggtcttcccccg

SEQ ID NO: 460254 - DNA, 537 bp, Homo sapiens; identical to SEQ ID NO: 445697
  misc_feature: HEFZJCU01AKHIM.14.57.F02.1.454.heavy.3.raw

SEQ ID NO: 460255 - DNA, 409 bp, Homo sapiens; identical to SEQ ID NO: 444519
  misc_feature: HEFZJCU01BTCOY.3.41.D08.1.454.heavy.3.raw

SEQ ID NO: 460256 - DNA, 323 bp, Homo sapiens; identical to SEQ ID NO: 444416
  misc_feature: HEFZJCU01BWXC6.47.38.D05.1.454.heavy.3.raw

SEQ ID NO: 460257 - DNA, 508 bp, Homo sapiens; identical to SEQ ID NO: 446002
  misc_feature: HEFZJCU01DOUIP.9.78.H01.1.454.heavy.3.raw

SEQ ID NO: 460258 - DNA, 508 bp, Homo sapiens
  misc_feature: HEFZJCU01AJYI2.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaacacagggactgcagtggattggatacatctacttcagtgggaaccccaactacaacccctccctcaggagtccagtcgccatatccctggactcgtccaacaaccagatctccctgacgatgacatctgtgaccgctgcggacacagccgtttattactgtgcgcgatctgggcgactcagtgactatggtatggacgtctggggccaagggaccacggtcatcgtctcctcagcctccaccaacgggcccatcggtcttccccc

SEQ ID NO: 460259 - DNA, 336 bp, Homo sapiens; identical to SEQ ID NO: 444510
  misc_feature: HEFZJCU01BNH33.3.31.C09.1.454.heavy.3.raw

SEQ ID NO: 460260 - DNA, 505 bp, Homo sapiens
  misc_feature: HEFZJCU01EQ8UE.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgtatgcctttgtatatgtggggccgaagggacgaatggtcaccgtcttcc

SEQ ID NO: 460261 - DNA, 506 bp, Homo sapiens; identical to SEQ ID NO: 444696
  misc_feature: HEFZJCU01D9GEP.16.34.D01.1.454.heavy.3.raw

SEQ ID NO: 460262 - DNA, 520 bp, Homo sapiens; identical to SEQ ID NO: 446666
  misc_feature: HEFZJCU01B53OG.7.78.H01.1.454.heavy.3.raw

SEQ ID NO: 460263 - DNA, 505 bp, Homo sapiens
  misc_feature: HEFZJCU01CHUKD.4.57.F02.1.454.heavy.3.raw
agcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttcg

SEQ ID NO: 460264 - DNA, 507 bp, Homo sapiens
  misc_feature: HEFZJCU01C43FA.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccgattcaccatctccagagacgattccaagaacacgttgtatcttcaatgaacagcctgacagtcgacgacacggccatgtatttttgtgcgagcgacccggggctcctcaatggctttcattacg

SEQ ID NO: 460265 - DNA, 481 bp, Homo sapiens
  misc_feature: HEFZJCU01EYVB9.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagacggcccccat

SEQ ID NO: 460266 - DNA, 488 bp, Homo sapiens; identical to SEQ ID NO: 449258
  misc_feature: HEFZJCU01DHIB9.12.53.E09.1.454.heavy.3.raw

SEQ ID NO: 460267 - DNA, 498 bp, Homo sapiens
  misc_feature: HEFZJCU01DEWT0.51.78.H01.1.454.heavy.3.raw
cgatcgtatacacgaccggtgctcgatttagtgtgagtagtttgggtttgggggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 460268 - DNA, 519 bp, Homo sapiens
  misc_feature: HEFZJCU01CSX4I.13.65.F10.1.454.heavy.3.raw
tcacgtactacacgaccggtgctcgatttagctacgctctaaggggacccaaaaaccacacccctccttgggagaatcccgtagatcacagctcctcaccatggactggacctggagcatccttttcttggtggcagcggcaacaggtgtccaccctgaggttcagttggttcagtctggaggagggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggacgtttttggggcgcggactcctcttgagatctgggccagggggacaatggtcaccgtctcttcag

SEQ ID NO: 460269 - DNA, 510 bp, Homo sapiens
  misc_feature: HEFZJCU01AX85I.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgcgaaagatcgtcgggctgggttccgcggtccgggt

SEQ ID NO: 460270 - DNA, 465 bp, Homo sapiens; identical to SEQ ID NO: 444805
  misc_feature: HEFZJCU01DVHV3.19.10.A10.1.454.heavy.3.raw

SEQ ID NO: 460271 - DNA, 467 bp, Homo sapiens; identical to SEQ ID NO: 445375
  misc_feature: HEFZJCU01EH0UQ.4.10.A10.1.454.heavy.3.raw

SEQ ID NO: 460272 - DNA, 526 bp, Homo sapiens
  misc_feature: HEFZJCU01DSKBV.9.30.C08.1.454.heavy.3.raw
tgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgactccatcaccggtactaattactactggagttggatccgccagccccccgggaagggcctggagtggattggatacgccttttacagtggagtcacctactacaacccgtccctcaagagccgagttaccatatctgtcgacacgtcccagaatcagttctccctggagtgacctctgtgactgccgcagactcggccgtgtatttctgtgccagaacgcaaagcagcgcctactatacttttaaactttgacttctggggccaggggatcccgtggtcaccgtctcctcagcct

SEQ ID NO: 460273 - DNA, 526 bp, Homo sapiens
  misc_feature: HEFZJCU01BCO8X.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccaagagcacctctgggggcacacgcggcccgtcgggccgtgcctcggtcgaaggactacttcctagagacacg

SEQ ID NO: 460274 - DNA, 399 bp, Homo sapiens
  misc_feature: HEFZJCU01CVNHP.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaactcctgggtcaccgtctccacagcctccaccaagggcccatcggtcttccccctggccgccctgctccaggagcacctccgagagcacagcggccctgggctgcctggtcaaggactacttcctacgtgagct

SEQ ID NO: 460275 - DNA, 482 bp, Homo sapiens; identical to SEQ ID NO: 451792
  misc_feature: HEFZJCU01CYNG0.19.71.G05.1.454.heavy.3.raw

SEQ ID NO: 460276 - DNA, 513 bp, Homo sapiens
  misc_feature: HEFZJCU01AD830.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgacctttctggtatttcgatctctgggccgtggcaccctggtcactgtctcctcggcttccaccaagggcccatcggtcttcccctggcgccctgctccaggagcacctctgggggcacagcggtcccg

SEQ ID NO: 460277 - DNA, 487 bp, Homo sapiens
  misc_feature: HEFZJCU01AJPCS.4.6.A06.1.454.heavy.3.raw
agcactgtagcacgaccggtgctcgatttagatctactgacagggtctcccaggccttgtgaagacctcggagaccctgtccctcacttgcactgtctctggtggctccatcagcagtttctatggggcttggatccggcagcccccagggaagggactggaatggattgggaacacctattacagtgggagccccagctacaatccctccctcaagagtcgactcaccatctcggctgacccgtccaagaatcagttctccctgaggctgacctctgtgaccgccgctgacacggccgtctattactgtgggagacagtgcagtggtggttcgtgccccgagtactggggccgcggaatcttggtcaccgtctcctcagcctccaccaagggcccatcggtcttcccctggcgccctgctccaggagcacctccgagagcacagcggccctgggctgcctggtcaaggatacttccctacagtgct

SEQ ID NO: 460278 - DNA, 530 bp, Homo sapiens
  misc_feature: HEFZJCU01BJYGB.2.4.A04.1.454.heavy.3.raw
acgctcgacacacgaccggtgctcgatttagagtagtgatcagggggctttctgagagtcatggatctcatgtgcaagaaaatgaagcacctgtggttcttcctcctgctggtggcggctcccagatgggtcctgtcccagctgcagttgcaggagtcgggcccaggactggtgaagccttcggagaccctgtccctcacctgcactgtctctggtgcctccatcagcagtagtagttattactggggctggattcgccagcccccagggaaggggctggagtggattgggagtttctattatggtgggggaacctactacaacccgtccctcaagagtcgagtcaccgtatccttagacacgtccaagaaccaattctccctgaaactgaactctatgaccgccgcagacacggctgtttattattgtacggccgtgtaacgttggactactggggccagggagccgtggtcaccgtctcctcagcctccaccaaggcccatcggtcttccccctggccaccctcctcc

SEQ ID NO: 460279 - DNA, 526 bp, Homo sapiens
  misc_feature: HEFZJCU01D5CZ0.11.25.C03.1.454.heavy.3.raw
cgagagataccacgaccggtgctcgatttagtagtgtagatttgggtttgggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtcgtggggccaagggacc

SEQ ID NO: 460280 - DNA, 498 bp, Homo sapiens
  misc_feature: HEFZJCU01EI8VU.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatcctagtggctac

SEQ ID NO: 460281 - DNA, 410 bp, Homo sapiens; identical to SEQ ID NO: 445199
  misc_feature: HEFZJCU01B5LBX.9.11.A11.1.454.heavy.3.raw

SEQ ID NO: 460282 - DNA, 539 bp, Homo sapiens
  misc_feature: HEFZJCU01CFT7G.19.10.A10.1.454.heavy.3.raw
tactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccagcccgggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctagaagaccgagacacagccatttactattgtacaaatgaaatacgtgggggacggggggaaaattgggggccaagggaaccctggtctccgtctcgtcag

SEQ ID NO: 460283 - DNA, 462 bp, Homo sapiens
  misc_feature: HEFZJCU01EI2U3.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacgggggaaaattggggccagggaaccctggtctccgtctcgtcagcctccaccaagggcccatcggtcttcccctggcgccctgctccaggagcacctccgagagcacagcggccctgggctgcctggtcaaggctacttcccacgagagta

SEQ ID NO: 460284 - DNA, 527 bp, Homo sapiens
  misc_feature: HEFZJCU01EB8GL.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggagtacagtggcagctccaagtactactttgacttctggggccagggaaccctggtcaccgtctcctcagcctccaccaagggcccatcggtcttcccctggcgccctgctccaggagcacctccgacg

SEQ ID NO: 460285 - DNA, 516 bp, Homo sapiens
  misc_feature: HEFZJCU01C7M1S.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtgcagttgttcatctgaggcagtgttcaatggtatgcagactccgtgaagggccgattcaccatctccagagacaattccaggaacacaatgtatttggaaatgaacagcctaagtcctgaggacacgggtgtatactactgtacgaagggaggggggaaccgaggcgggagttccaagtactccttgacgtctgggccgac

SEQ ID NO: 460286 - DNA, 532 bp, Homo sapiens
  misc_feature: HEFZJCU01AE1K1.13.38.D05.1.454.heavy.3.raw
  modified_base (465)..(465): a, c, t, g, unknown or other
tcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtctggggggggcttggttaagcctggggggtccctcagactctcctgtgcaacctctggattcattttctctgacgcctggttgagctgggtccgccaggctcccgggaaggggctggagtgggttggccgtattaaaggtagaagacatggtcggacaacagactacagtgttcccgtgaaaggcagattcactatctcaagagatgactcaaaagaaatgatatatctgcaaatgaacaacctagaaaagcgaggacanaggcgtgtattactgtaccacagagtgggccagatgacaaatggccgcggacgagttcgactacgtc

SEQ ID NO: 460287 - DNA, 504 bp, Homo sapiens
  misc_feature: HEFZJCU01CTBW5.48.53.E09.1.454.heavy.3.raw
agtatacatacacgaccggtgctcgatttagagagagtgtgttgggtttggggagctctcagagaggtgccttagccctggattccaaggcatttccacttggtgatcagcactgaacacagaggactcaccatggagctggggctgtgctgggtcttccttgttgcttttttagaaggtgtccagtgtgaggtgcatctggtggagtctgggggagccttggtgcagcctggagagtccctaagactctcctgcgcagcctcaggattcagtttcagtagttatgaaatgaattgggtccgccaggctccagggaagggactggagtggctttcatatattactggcagtgggtctcttacccattatgcagactctgtgaggggccgattcaccatctccagagacaaccccgaaactctctttttctgcaatggacagcctgacagccgacgatacggccatttattactgtgcgagagatggggacccccgcactatacc

SEQ ID NO: 460288 - DNA, 506 bp, Homo sapiens; identical to SEQ ID NO: 450563
  misc_feature: HEFZJCU01A0KV3.49.49.E05.1.454.heavy.3.raw

SEQ ID NO: 460289 - DNA, 521 bp, Homo sapiens
  misc_feature: HEFZJCU01DMH4D.51.79.H02.1.454.heavy.3.raw
  modified_base (520)..(520): a, c, t, g, unknown or other
cgatcgtatacacgaccggtgctcgatttagtgtcacacgaagggaaaggggactttctgagactcatggacctcctgcacaagaacaagaaacacctgtggttcttcctcctcctggtggcagctcccagatgggtcctctctcaggtgcagctgcaggagtcgggcccaggactggtgaagccttcggggaccctgtccctcacctgcgctgtctctggtgtctccatccgcagtcctaattggtggagttgggtccgtcagcccccagggaagcggctggagtggattggggaaatctatcatactgagaacaccaactacaacccgtccctcgagagtcgagtcaccatgtcaatagacaagggcaacaatgagttctccctgaatctgcggtctgtgaccgccgcggacacggccgtgtattattgtgtgagagatcggcaagatagtagtggttattacatcggtgactacgacggtatggacgtcgtggggccaagggaccacggtcatcgtnt

SEQ ID NO: 460290 - DNA, 496 bp, Homo sapiens
  misc_feature: HEFZJCU01CQVP0.51.46.E02.1.454.heavy.3.raw
  modified_base (491)..(491): a, c, t, g, unknown or other
cgatcgtatacacgaccggtgctcgatttagactcatctacaggaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaggtggtggagtcggggggaggcgtggtccagcctgggaggtccctgagactctcctgtgcagcctctaaattcagtttcagtagatttggcgtgcactgggtccgccaggctccaggcaaggggctggagtgggtggcagttatatcatatgatggaaagaataaatactatggagactccgtgaagggccgattcaccatctctagagacaatctcaaggagacagtgcatctgcaaatgaacagcctgagaggtgacgacacggctgtgtattactgtcacctcgagagcagcaattgganagtta

SEQ ID NO: 460291 - DNA, 426 bp, Homo sapiens; identical to SEQ ID NO: 445931
  misc_feature: HEFZJCU01CKWY4.9.34.D01.1.454.heavy.3.raw

SEQ ID NO: 460292 - DNA, 532 bp, Homo sapiens
  misc_feature: HEFZJCU01D6FRZ.7.78.H01.1.454.heavy.3.raw
  modified_base (470)..(470): a, c, t, g, unknown or other
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcngtggaattgactactggggccagggaaccctggtcaccgtctcctcagcctccaccaacggg

SEQ ID NO: 460293 - DNA, 514 bp, Homo sapiens
  misc_feature: HEFZJCU01D0NMF.47.55.E11.1.454.heavy.3.raw
agctcacgtacacgaccggtgctcgatttagcactcgcacgttgggtttgggggagccgcagccctgggattcccagctgtttctgcttgctgatcaggactgcacacagagagctcaccatggagtctgggctgagcgtggttttccttgttagctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccagggtaacccg

SEQ ID NO: 460294 - DNA, 404 bp, Homo sapiens
  misc_feature: HEFZJCU01C538W.16.72.G06.1.454.heavy.3.raw
tgtactactccacgaccggtgctcgatttagctacgactgcaagggaaaggggctggagtgggtctcatctattagtagtagtgatagtgccacatactacgcagactccgtgaagggccggttcaccatctccagagatagatccaagaacacgctgtatctgcaaatggacagcctgagagccgaggacacggccatatattactgtgcgaaagatctggggaatgactacgatggtaccaacgtccgcttggactcctggggccagggagccctggtcaccgtctcctcagcctccaccaagggcccatcggtcttccccctggcgccctgctccaggagcacctcccgagagcacagcggccctgggctgcctggtcaaggactacttccgagtagtaca

SEQ ID NO: 460295 - DNA, 538 bp, Homo sapiens
  misc_feature: HEFZJCU01CR167.22.34.D01.1.454.heavy.3.raw
acatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactcccacccctccctcaagagtcgagccaccatatcagtcgacacgtccaagaaccagttctccctgaaactgaggtctgtgaccgcagcggacacggccgtgtattactgtgcgagagagtccgggtccgatatctggccgttcgacccctgggccagggaaccctggtcaccgtctcctcagcctccaccaagggcccatcggtcttcccctggcgccctgctccaggagcacctccgagagcacagcggccctgggctgcctggtcaaggactacttccacg

SEQ ID NO: 460296 - DNA, 518 bp, Homo sapiens; identical to SEQ ID NO: 453293
  misc_feature: HEFZJCU01CC15E.9.34.D01.1.454.heavy.3.raw

SEQ ID NO: 460297 - DNA, 482 bp, Homo sapiens
  misc_feature: HEFZJCU01CK7VX.19.71.G05.1.454.heavy.3.raw
tactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgagacacgggtgtatattactgtggaagaggcccccatagacatgccacctcgtctctggtgct

SEQ ID NO: 460298 - DNA, 500 bp, Homo sapiens
  misc_feature: HEFZJCU01A0RX3.49.41.D08.1.454.heavy.3.raw
agtcgagagacacgaccggtgctcgatttagtcacgcgagaaagggaaaggggggtgatcatcactgaacacagaggactcaccatggagtttgggctgagctgggttttcctcgttgctcttttaagaggtgtccagtgtcaggtgcttctggtggactctgggggaggcgtggtccggcctgggaggtccctgagactctcctgtgcagcctctcagttcaccttcagtgtctatactatgcactgggtccgccaggctccaggcaaggggctggagtgggtggcacttatatcaaatgatggaagaattcaacactacgcaggctccgtgaagggccgattcaccatctccagagacaattccaagaacacactgtctctgcaaatgaatagcctgagagttgaggacacggctgtctattactgtgcgagagctaagggacttactcatagatttgactactggagccagggagccctggtccaccgtctcctcag

SEQ ID NO: 460299 - DNA, 529 bp, Homo sapiens; identical to SEQ ID NO: 446480
  misc_feature: HEFZJCU01C88TW.18.33.C11.1.454.heavy.3.raw

SEQ ID NO: 460300 - DNA, 532 bp, Homo sapiens
  misc_feature: HEFZJCU01BPS6N.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactcggctcggcccctgggggcccgggaaccctggtcaccgtctcctcagcctccaccaagggcccatcggtcttcccctggcaccctcctcc

SEQ ID NO: 460301 - DNA, 518 bp, Homo sapiens
  misc_feature: HEFZJCU01CSC8V.40.33.C11.1.454.heavy.3.raw
tctagcgactcacgaccggtgctcgatttagagtgagctcgttgggtttgggtgctcgatttagagtgagctcgttgggtttgggaggcttagttcagcctggggggtccctgagactctcctgtgcagcctctggagtcactctctccgcctactgggtactctgggtccgccaagctccagggaaggggctggagtgggtcgcacgtatttataaagatggatccacagcgtacgcggactccgtgaagggccgattcaccatctccagagacaacgccaagaacacagtgtctctgcaaatggacagtctgagagccgaggacacgggtgtctattattgtacaaaagtggggactaatgaatatggtgtggacgtctggggccaagggaccacggtcgtcgcctcttatgcctccaccaagggcccatcggtcttcccctggcgccctgctccaggagcacctccgagagcacagcggccctgggctggcctggtcaaggactacttccagtcg

SEQ ID NO: 460302 - DNA, 518 bp, Homo sapiens; identical to SEQ ID NO: 450435
  misc_feature: HEFZJCU01DDH4N.13.76.G10.1.454.heavy.3.raw

SEQ ID NO: 460303 - DNA, 509 bp, Homo sapiens
  misc_feature: HEFZJCU01EYY09.16.38.D05.1.454.heavy.3.raw
tgtactactccacgaccggtgctcgatttagtatctgatagttgggtttgggctgggagacgagcccagcactggaagtcgccggtgtttccattcggtgatcagcactgaatacagaggactcaccatggagtttgggctgagctgggttttcctcgttactcttttaagaggtgtccaatgtcaggtgcagttggtggagtctgggggaggcgtggtccagcctggaaggtccctgagactctcgtgtgcagcgtctggattcatctttaatagttttcctatgcactggatccgccaggctccaggcaggggactggagtgggtggcaggagtgtcacttgatggagccaatacatacttcgcagactccgtgaagggccgattcaccatttccagagagaattccaacaacacgctgcatctgcaaatggacaccctgagacctgacgacacggctgtctattactgtgtgagactcttattgcgtttcgggctttgacttacgg

SEQ ID NO: 460304 - DNA, 505 bp, Homo sapiens
  misc_feature: HEFZJCU01ELFQ2.51.71.G05.1.454.heavy.3.raw
cgatcgtatacacgaccggtgctcgatttagtgtcgtcgcaagagagagggggagctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctgggagtgggtggcagttatatcctatgatggaagcaataagcactacgcagagtccgtgaagggccgattgaccatctccagagacaactcgaagaatacggttcttctaacaaatgaacagcctgagagctggaggagacggctattgttttacgtgtgcgaggacgggaactcgattacg

SEQ ID NO: 460305 - DNA, 502 bp, Homo sapiens
  misc_feature: HEFZJCU01C852X.7.85.H08.1.454.heavy.3.raw
cgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctggggggtccctgagactctcctgtgcagcctctggatttaccttcagtacttatggcatgaactgggtccgccaggctccagggaaggggctgcagtgggtttcacacattaatactgggaagtaggaccataacttacacagactctgtgaagggccgattcaccacctccagagacgacgccaagaactcactgtctctgcaaatgaacagcctgagagtcgaggacacggctgtgtattactgtgcgagagatccggagggggacgtatgacc

SEQ ID NO: 460306 - DNA, 499 bp, Homo sapiens
  misc_feature: HEFZJCU01ERKLB.47.56.F01.1.454.heavy.3.raw
agctcacgtacacgaccggtgctcgatttagcagacgtctgaacacacaaagggggccccagccctgggattcccagctgtttctgcttgctgatcaggactgcacacagagaactcaccatggagtttgggctgagctgggttttccttgttgctattttaaaaggtgtccagtgtgaggtgcaactggtggagtccgggggaggcttaattcagcctggggggtccctgagactctcctgtgcagcctctggattcaccttcagtagttactggatgcactgggtccgccaagctccagggaagggactggtgtgggtctcacgtattaatcctgatggaagtcgcacaaactacgcggactccgtgagggaccgattcaccatctccagagacaacgccaagaacacgctgtatctgcaaatgcacagtctgagagccgacgatgcggctgtatatttctgtgcaagagatcaactggtgggaccgtacttatttc

SEQ ID NO: 460307 - DNA, 513 bp, Homo sapiens
  misc_feature: HEFZJCU01EIMPU.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtcccccaacacagggactgcagtggattggatacatctacttcagtgggaaccccaactacaaccctccctcaggagtccagtcgccatatccctggactcgtccaacaaccagatctccctgacgatgacatctgtgaccgctgcggacacagccgtttattactgtgcgcgatctgggcgactcagtgactatggtatggacgtctggggccaagggaccacggtcatcgtctcctcagcctccaccaagggcccatcggtcttccccctggcca

SEQ ID NO: 460308 - DNA, 370 bp, Homo sapiens
  misc_feature: HEFZJCU01A8L44.3.1.A01.1.454.heavy.3.raw
agacgcactccacgaccggtgctcgatttagacgtctcatccatcagtagtactagtagtaacatatactacgaagactcagtgaagggccgattcaccatctccagagacaaagccaagaactcactgtatctggaaatgaacagcctgagagccgaggacacggctgtgtattactgtgcgagagggcggctttggggttcaggaccgtcctacgctatggacgtctggggccaagggaccacggtcaccgtctcctcagcctccaccaagggcccatcggtcttcccctggcgccctgctccaggagcacctccgagagcacagcggccctgggctgcctggtcaaggactacttccgagtgcgtct

SEQ ID NO: 460309 - DNA, 518 bp, Homo sapiens
  misc_feature: HEFZJCU01D5AFD.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgagacacggccgtatattactgtgcgagaataacccgtcgcctggttattacc

SEQ ID NO: 460310 - DNA, 522 bp, Homo sapiens
  misc_feature: HEFZJCU01EJ8W9.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaagggctggagtggctcgcacttatttatagtggtggtaccacatactacacagactccgtgaagggccgattcaccatctcagaagacaattccaggaacacattgtatcttcaaatgaataacctgagagccgaggacacggccatgtattactgtgtgggggcatttacttgaccccgtggggccggggaacccgtggtcaccgtcc

SEQ ID NO: 460311 - DNA, 427 bp, Homo sapiens; identical to SEQ ID NO: 444708
  misc_feature: HEFZJCU01BTFH9.9.34.D01.1.454.heavy.3.raw

SEQ ID NO: 460312 - DNA, 524 bp, Homo sapiens
  misc_feature: HEFZJCU01B2VKB.53.76.G10.1.454.heavy.3.raw
cgcgtatacacacgaccggtgctcgatttagtcactcatacaggggttgggggcaacttataaacccaaaaggaatggccatgcagcgggtagggacaatacagacagatctcagcctgaaatggagcctcagggcacaggtgggcacggacactgtccacctaagccaggggcagacccgagtgtccccgcagtagacctgagagcgctgggcccacagcctcccctcggtgccctgctacctcctcaggtcaggcctggacatcccgggtttccccaggcctggcggtaggtttggggtgaggtctgtgtcactgtggtatgacgatttttggcgtggtttttccttcactattactcccactactacggtttggacgtctggggccaagggaccacggtcaccgtctcctcagcctccaccaagggcccatcggtcttcccctcggcaccctcctccaagagcacctctgggggcacagcgccctgggctgcctggtcaaggactacttcctcgtactgcg

SEQ ID NO: 460313 - DNA, 331 bp, Homo sapiens
  misc_feature: HEFZJCU01CP133.48.24.C02.1.454.heavy.3.raw
agtatacatacacgaccggtgctcgatttagtacagatcgttagggaaagggccgattcaccatctccagagacaacgccaagcactcactgtatctccaaatgaacagcctgagagccgacgacacggctgtgtattactgtgcgagacttgggagagagtgggacctactgttccactttgactactggggccagggaaccctggtcaccgtctcctcagcctccaccaagggcccatcggtcttccccctggcaccctcctccaagagcacctctgggggcacagcggccctgggctgcctggtcaaggactacttcctatgtatact

SEQ ID NO: 460314 - DNA, 502 bp, Homo sapiens
  misc_feature: HEFZJCU01EHIZD.21.61.F06.1.454.heavy.3.raw
tcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtgcgacaggcccctggacaaggacttgagtggatgggatggatcagcgcttacaatggttacacaaactatgcacagaaactccagggcagagtcaccatgaccacagacacatccacgagcacagcctacatggagctgaggagcctgagatctgacgacacggccgtgtattactgtgcgagaggcttagcagtggcccggttcgacccctggggccagggaaccctc

SEQ ID NO: 460315 - DNA, 523 bp, Homo sapiens
  misc_feature: HEFZJCU01BPK5P.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggcctgtctattattgcgcgagagagacacacgaacctactggccaatactatgggggcttgttctggggccaggggaccctggtcatcgtctccccagcctccaccaagggcccatcggtcttcccctggccg

SEQ ID NO: 460316 - DNA, 500 bp, Homo sapiens; identical to SEQ ID NO: 446033
  misc_feature: HEFZJCU01B3NZF.11.27.C05.1.454.heavy.3.raw

SEQ ID NO: 460317 - DNA, 518 bp, Homo sapiens
  misc_feature: HEFZJCU01C82O1.47.64.F09.1.454.heavy.3.raw
agctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcaccagttttaattattggtggggctggatccgccagccccagggaaggggctggaatggattgggagtatattttataatggggacactctttacaacccatccctcaagagtcgagtttccatatccgcagacacgtccgagaatcacttctccctgaaactgagctctgtgaccgccgcagacacggctgtttattactgtttcgagacatgccgaccgagagcattatcggcagtacggttttgatatttggggccaagggacaagggtcaccgtctcgcagcctcaccg

SEQ ID NO: 460318 - DNA, 509 bp, Homo sapiens
  misc_feature: HEFZJCU01DI6HF.10.28.C06.1.454.heavy.3.raw
catagtagtgcacgaccggtgctcgatttagagctcacgtattgggtttggggggaagaggaagactgacggtcctgccacaggtggtgctgggcacggtgggcactcgacacaacatttgcgctcaactgtcttgactcaccatggagttggggctgtgctgggttttccttgttgctattttagaaggtgtccggtgtgaggtgcagctggtggagtcggggggaggcttggtacagcctggggggtccctgagactctcctgtgtagcgtctggattcacattcagtagttatagcatgaactgggtccgccaggctccagggaaggggctggagtgggtttcatatattgatagaaatagtggaaccatatactatgcagactctgtgaggggccgattcaccatctccagagacaatgccaggaattcactgtatgtagaaatgaacagtctgagagccgaggacacggctctctattactgtgcgagacgaccccgaaaatac

SEQ ID NO: 460319 - DNA, 487 bp, Homo sapiens; identical to SEQ ID NO: 445219
  misc_feature: HEFZJCU01C8Y61.10.85.H08.1.454.heavy.3.raw

SEQ ID NO: 460320 - DNA, 518 bp, Homo sapiens
  misc_feature: HEFZJCU01CGVSK.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctgggccagggaacctggtcaccgtctcctcagcctccaccaagggcccatcggtcttcccctggcaccctcctccaagagcacctctgggggcacagcggccctgggctgcctggtcaaggactacttccgagtagtacacg

SEQ ID NO: 460321 - DNA, 506 bp, Homo sapiens
  misc_feature: HEFZJCU01DYCOO.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaagtgacgtggtagttccggggggacacatgacaccg

SEQ ID NO: 460322 - DNA, 486 bp, Homo sapiens; identical to SEQ ID NO: 448316
  misc_feature: HEFZJCU01C40WJ.3.48.E04.1.454.heavy.3.raw

SEQ ID NO: 460323 - DNA, 535 bp, Homo sapiens
  misc_feature: HEFZJCU01DMXE0.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaagtatggctgtgtttattggggccagggagccctggtctaccg

SEQ ID NO: 460324 - DNA, 483 bp, Homo sapiens; identical to SEQ ID NO: 444924
  misc_feature: HEFZJCU01DQ64E.10.35.D02.1.454.heavy.3.raw

SEQ ID NO: 460325 - DNA, 395 bp, Homo sapiens; identical to SEQ ID NO: 453087
  misc_feature: HEFZJCU01D0F6U.47.46.E02.1.454.heavy.3.raw

SEQ ID NO: 460326 - DNA, 502 bp, Homo sapiens
  misc_feature: HEFZJCU01AYD3W.49.21.B10.1.454.heavy.3.raw
agtcgagagacacgaccggtgctcgatttagtgtcgtcgcaagggggctctgggagacgagcccagcactggaaggcgccggtgtttccattcggtgatcagcactgaacacagaggactcaccatggagtttgggctgagctgggttttcctcgttggtcttttaagaggtgtccagtgttatgtgcagttggtggagtctgggggaggcgtggtccagcctgggaagtcactgagactcgcctgtacaccctctggattcaccttcagcaactatgcaatgcactgggtccgcctggctcccggcaagggtctggactgggtggcaggtatatcagctgatgggaccaaaatatactacgcaaactccgtgaagggccgattcaccatatcaagagacacttccgatgacacaatctatctgcaaatagaacagcctgaaagttgacgacacgggtctttttactgtgcgcctggaagcagtggctggccacatgatgtt

SEQ ID NO: 460327 - DNA, 491 bp, Homo sapiens; identical to SEQ ID NO: 445333
  misc_feature: HEFZJCU01ADWW9.19.53.E09.1.454.heavy.3.raw

SEQ ID NO: 460328 - DNA, 514 bp, Homo sapiens
  misc_feature: HEFZJCU01C01BI.9.34.D01.1.454.heavy.3.raw
  modified_base (470)..(470): a, c, t, g, unknown or other
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaatacgattttcgatccctccgcagtcgacactttgattactggggccgggaaccctggtcgccgtctcctcagcctcaccaaggcccatcggtcttcccctggcaccctcctccaagagcacctcgtggggcacngcggccctgggctgcctggtcaaggactacttccagacgtatca

SEQ ID NO: 460329 - DNA, 523 bp, Homo sapiens
  misc_feature: HEFZJCU01EOWHL.5.33.C11.1.454.heavy.3.raw
atcagacacgcacgaccggtgctcgatttagagtgagctcgttgggtttgggggaggcttggtccagcctggggggtccctgagactctcctgtgtagcctccggattcacctttagtgcctattggatgacctgggtccgccaggctccagggaaggggctggagtgggtggccaatataagattcgatggaagtgaggtgtactatgtggactctgtgaagggccgattcaccatctccagagacaacgccgagaactcactgtatctccaaatgaacagcctgagagccgaggacacggctgtctactactgtacgaatatcccctcgttttacgatttttggactggcccgttggggtactcctacggtttggacgtctggggccaagggaccacggtcaccgtctcctcagcctccaccaagggcccatcggtcttcccctggcgccctgctccaggagcacctccgagagcacagcggccctgggctgcctggtcaaggactactcccgtgtctgat

SEQ ID NO: 460330 - DNA, 508 bp, Homo sapiens
  misc_feature: HEFZJCU01CIGVD.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggcctccgagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggacg

SEQ ID NO: 460331 - DNA, 526 bp, Homo sapiens
  misc_feature: HEFZJCU01CRXTN.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgttctattattgtgtgagtagttttatggcgatgggcttgggtggacaggatccacgtcgggggcctaac

SEQ ID NO: 460332 - DNA, 495 bp, Homo sapiens; identical to SEQ ID NO: 449890
  misc_feature: HEFZJCU01DMSSB.48.59.F04.1.454.heavy.3.raw

SEQ ID NO: 460333 - DNA, 496 bp, Homo sapiens
  misc_feature: HEFZJCU01BS9PL.52.15.B04.1.454.heavy.3.raw
cgcagtacgacacgaccggtgctcgatttagacagtatatatccgcggggtccagtgtcaggtgcagctggtggagtctgggggaggcgtggtccagcctgggaggtccctgagactctcctgtgcaggctctgcatttcccttcaataactatgctatcgattgggtccgccaggctccaggcaagggactggagtgggtggcagtaatatcagctgatggaggcactaaatattacgctgattctgcgaggggccgattcaccatatccagagacaactcccaagatgtgatatatctacaaatgaacagcctgagacctgaggacacggctgtatattattgtgcgtcagggggcagtgcctggccacgtgatgcttttgatttctggggccaagggacattcgtcaccgtctcctcagcctccaccaagggcccatcggtcttcccctcggcaccctcctccaagagcacctctgggggcacagcggccctc

SEQ ID NO: 460334 - DNA, 488 bp, Homo sapiens
  misc_feature: HEFZJCU01COI16.49.75.G09.1.454.heavy.3.raw
agtcgagagacacgaccggtgctcgatttagtatagacatcagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgcttcatcatctccagagacaactccgagaacacgctgtatctgcaaatgaacaggctgagagttgaagacacggctgtatattactgtgcgaacttaatcacggaggacaac

SEQ ID NO: 460335 - DNA, 509 bp, Homo sapiens
  misc_feature: HEFZJCU01ELI65.52.83.H06.1.454.heavy.3.raw
cgcagtacgacacgaccggtgctcgatttagatcacgtgcgtcgcgggtctctgggagaggagcccagcactagaagtcggcggtgtttccattcgctgatcagcactgaacacagaggactcaccatggagtttgggctgagctgggttttcctcgttgctcttttaagaggtgtccagtgtcaggtgcagatggtggagtctgggggaggcgtggtccagcctgggaggtccctgagactctcctgtgtagcctctggattcaccttcagggtctatgacatgcactgggtccgccaggctccaggcaaggggctggagtgggtggcatttatatcaaatgatggaagtaacaaatactatgtagactccgtgaagggccgattcaccatctccagagacaattccaagaatacgctgtatctgcacatgaacagcctgagagccgaagacacgggtgtttattactgtgcgaacttaattacggaggacaacggtaaccccgtccg

SEQ ID NO: 460336 - DNA, 514 bp, Homo sapiens
  misc_feature: HEFZJCU01AP3N7.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctggggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtagaaggcagattcatcatctcaagagatgattccaacggcatcgcctatctgcagatgaacagcctgaagaccgaggacacagccgtctattactgtggttagggtagttttacgtagtttttggt

SEQ ID NO: 460337 - DNA, 509 bp, Homo sapiens; identical to SEQ ID NO: 445824
  misc_feature: HEFZJCU01A7H7X.9.14.B03.1.454.heavy.3.raw

SEQ ID NO: 460338 - DNA, 517 bp, Homo sapiens; identical to SEQ ID NO: 458262
  misc_feature: HEFZJCU01A1416.9.34.D01.1.454.heavy.3.raw

SEQ ID NO: 460339 - DNA, 541 bp, Homo sapiens
  misc_feature: HEFZJCU01DJCNU.18.59.F04.1.454.heavy.3.raw
tacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacatcccctgaaagcgtcaactactactactacggtatggacctctggggccaagggaccg

SEQ ID NO: 460340 - DNA, 503 bp, Homo sapiens
  misc_feature: HEFZJCU01BZL0E.12.55.E11.1.454.heavy.3.raw
atacgacgtacacgaccggtgctcgatttagcactcgcacgttgggtttggggagacgagcccagcactggaagtcgccggtgtttccattcggtgatcatcactgaacacagaggactcaccatggagtttgggctgagctgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgtaccttttctggtatttcg

SEQ ID NO: 460341 - DNA, 523 bp, Homo sapiens; identical to SEQ ID NO: 448340
  misc_feature: HEFZJCU01CUZMQ.12.33.C11.1.454.heavy.3.raw

SEQ ID NO: 460342 - DNA, 512 bp, Homo sapiens
  misc_feature: HEFZJCU01ET5D2.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtcgtggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctcattccgttcatctgaatactggggccagggaaccctggtcgtccg

SEQ ID NO: 460343 - DNA, 512 bp, Homo sapiens
  misc_feature: HEFZJCU01BDQZ6.14.41.D08.1.454.heavy.3.raw
  modified_base (451)..(451): a, c, t, g, unknown or other
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttctccctgaagctgagctctgtgactgccgcggacacggccgtgtattactgtgcgaggtcgattgtgatggtaacaactgcttcttactcctttgaccagtgggccggggaaccctgggtcaccgtctcttcngcctccaccaaggccatcggtcttccctgcgcctgctccaggagcacctccgagacgcacg

SEQ ID NO: 460344 - DNA, 498 bp, Homo sapiens
  misc_feature: HEFZJCU01BYR2J.10.71.G05.1.454.heavy.3.raw
  modified_base (468)..(468): a, c, t, g, unknown or other
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatggcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccggaggacacgggtntttattactggtgggagaaatcctagtggc

SEQ ID NO: 460345 - DNA, 512 bp, Homo sapiens
  misc_feature: HEFZJCU01CCRE0.48.26.C04.1.454.heavy.3.raw
agtatacatacacgaccggtgctcgatttagtctagcgactttgggtttggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagaagggttttacatggttcggggagtctccgacccagcaactggttcgaccccg

SEQ ID NO: 460346 - DNA, 513 bp, Homo sapiens
  misc_feature: HEFZJCU01B1F3B.4.39.D06.1.454.heavy.3.raw
agcactgtagcacgaccggtgctcgatttagtgacatctcgcagttctttgggttttggggggaagtgtggtacggcctggggggtccctgagactctcctgtacagcctctggattctcctttgatgattatggcatgagctgggtccgccaagctccagggaaggggctggagtgggtgtctggtatgaattggagtggcggtagtacagcttatgcagactctgtgaagggccgattcaccatctccagagacaacgccaagaactccctgtatctgcaattgaacagtctgagagccgaggacacggccttgtattactgtgcgagaacatttagggtgtgtagtggtaacagctgctattcgtcgactgggtttgactactggggccagggagccctggtcaccgtctcctcagcctccaccaagggcccatcggtccttcccctggcgccctgctccaggagcacctccgagagcacagcggccctgggctgcctggtcaaggacta

SEQ ID NO: 460347 - DNA, 501 bp, Homo sapiens; identical to SEQ ID NO: 449393
  misc_feature: HEFZJCU01EF3KF.17.10.A10.1.454.heavy.3.raw
  modified_base (460)..(460): a, c, t, g, unknown or other

SEQ ID NO: 460348 - DNA, 491 bp, Homo sapiens
  misc_feature: HEFZJCU01ATMKD.52.15.B04.1.454.heavy.3.raw
cgcagtacgacacgaccggtgctcgatttagacagtatatatccgcggggtctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctgggggaggcgtggtccagcctgggaggtccctgagactctcctgtgcaggctctgcatttcccttcaataactatgctatcgattgggtccgccaggctccaggcaagggactggagtgggtggcagtaatatcagctgatggaggcactaaatattacgctgattctgcgaggggccgattcaccatatccagagacaactcccaagatgtgatatatctacaaatgaacagcctgagacctgaggacacggctgtatattattgtgcgtcgaggggcagtgtccg

SEQ ID NO: 460349 - DNA, 518 bp, Homo sapiens
  misc_feature: HEFZJCU01BMXGN.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggccaggggaccctggtcatcgtctccccagcctccaccaagggcccatcggtcttccccc

SEQ ID NO: 460350 - DNA, 507 bp, Homo sapiens
  misc_feature: HEFZJCU01DTWZ3.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggccgcctgctccaggagcacctccgagagcacagcggccc

SEQ ID NO: 460351 - DNA, 505 bp, Homo sapiens; identical to SEQ ID NO: 447076
  misc_feature: HEFZJCU01EZBRR.10.38.D05.1.454.heavy.3.raw

SEQ ID NO: 460352 - DNA, 481 bp, Homo sapiens
  misc_feature: HEFZJCU01D7MSX.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttccccctggcgccctgctccaggagcacctccgatagcacagcggccctgggctgcctggtcaaggactacttccagacgtatca

SEQ ID NO: 460353 - DNA, 515 bp, Homo sapiens
  misc_feature: HEFZJCU01CL4L4.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgtagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatgggggcccacgaacgttactacgctatgacgtctggggccaaggg

SEQ ID NO: 460354 - DNA, 495 bp, Homo sapiens
  misc_feature: HEFZJCU01EO8J0.3.26.C04.1.454.heavy.3.raw
agacgcactccacgaccggtgctcgatttagtctagcgactttgggtttgggggggagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctgggccgtggcaccctgctgactgtctcctcagcctccaccaagggcccatcggtcttcccctggcgccctgctccaggagcacctccgagagcacagcggccctggctgcctggtcaaggactacc

SEQ ID NO: 460355 - DNA, 496 bp, Homo sapiens; identical to SEQ ID NO: 444697
  misc_feature: HEFZJCU01B767D.16.37.D04.1.454.heavy.3.raw

SEQ ID NO: 460356 - DNA, 532 bp, Homo sapiens; identical to SEQ ID NO: 445228
  misc_feature: HEFZJCU01EOVJV.7.78.H01.1.454.heavy.3.raw

SEQ ID NO: 460357 - DNA, 379 bp, Homo sapiens; identical to SEQ ID NO: 444450
  misc_feature: HEFZJCU01EYKM1.47.77.G11.1.454.heavy.3.raw

SEQ ID NO: 460358 - DNA, 506 bp, Homo sapiens
  misc_feature: HEFZJCU01DOOEH.49.20.B09.1.454.heavy.3.raw
agtcgagagacacgaccggtgctcgatttagtgtagtgtgaaggggacccaacaaccacatccctcctcagaagcccccagagcacaacgcctcaccatggactggacctggaggatcctctttttggtggcagcagccacaggtgcccactcccaggtccagcttgtgcagtctggggctgagttgaagaagcctggggcctcagtgagggtttcctgcgtggtctccggatacaccttcactagtcatcctatgcattgggtgcgccaggcccccggacaaaggtttgagtggatgggatggatcaccgctggcaatggtgacacaaaatattcagagaagttccagggcagagtctccattaccagggacacagctgcgagtacagggtacatggaactgagtggcctgagatctgaggacacggctgtttatactgtgcgagagggaagtgggatattgtggcagctccaggtgcccagccgggccctactttgactacgtc

SEQ ID NO: 460359 - DNA, 506 bp, Homo sapiens
  misc_feature: HEFZJCU01D53HE.49.20.B09.1.454.heavy.3.raw
agtcgagagacacgaccggtgctcgatttagtgtagtgtgaaggggacccaacaaccacatccctcctcagaagcccccagagcacaacgcctcaccatggactggacctggaggatcctctttttggtggcagcagccacaggtgcccactcccaggtccagcttgtgcagtctggggctgagttgaagaagcctggggcctcagtgagggtttcctgcgtggtctccggatacaccttcactagtcatcctatgcattgggtgcgccaggcccccggacaaaggtttgagtggatgggatggatcaccgctggcaatggtgacacaaaatattcagagaagttccagggcagagtctccattaccagggacacagctgcgagtacagggtacatggaactgagtggcctgagatctgaggacacggctgtttattactgtgcgagagggaagtgggatattgtggcagctccaggtgcccagccgggccctactttgactactc

SEQ ID NO: 460360 - DNA, 492 bp, Homo sapiens; identical to SEQ ID NO: 445919
  misc_feature: HEFZJCU01A5Q43.14.25.C03.1.454.heavy.3.raw

SEQ ID NO: 460361 - DNA, 557 bp, Homo sapiens
  misc_feature: HEFZJCU01E1A7E.51.28.C06.1.454.heavy.3.raw
cgatcgtatacacgaccggtgctcgatttagagctcacgtattgggtttgggctgagctgggttttcctcgttgctcttttaagaggtgtccagtgtcaggtgcacctggtggagtctggggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctcccagagacaattccgggaacgacactgtctctgcaaatgaacagcctgagagctgaggacagggcgtgtttattactgtgtgcgatccgacctcactggtacggggagttacttcctccgcaacggtatggacgtctggggccaagggaccacggtcaccgtctccttagtcctcctaccaaacgggccccgatccggtcttccccccttcgggccaccctcccctccaacgacggacacccttccg

SEQ ID NO: 460362 - DNA, 400 bp, Homo sapiens; identical to SEQ ID NO: 444452
  misc_feature: HEFZJCU01A4CPQ.47.24.C02.1.454.heavy.3.raw

SEQ ID NO: 460363 - DNA, 522 bp, Homo sapiens
  misc_feature: HEFZJCU01EUN9Y.5.78.H01.1.454.heavy.3.raw
atcagacacgcacgaccggtgctcgatttagtgtgagtagtttgggtttgggggggtgatcagcactgaacacagaggactcaccatggtaggtttgggctgaggctgggttttcctcgttgctcttttaagaggtgtccagtgtcaggtgcagctggtggagtctgggggaggcgtggtccagcctgggaggtccctgagactctcctgtgcagcctctggattcaccttcagtagctatgactccgtgaagggccgattcaccatctccagagacaattccaagaacactctgtatctgcaaatggacagcctgagacctgaggacacggctgtgtattactgtgcgaaagaaaccggcgggcagtggctgggcccatttgaccactggggccagggaaccctggtcaccgtctcctcagcctccaccaagggcccatcggtcttcccctggcacctcctccaagagcacctctgggggcacgagcggccctgggctgtctggtcaaggactacttcccg

SEQ ID NO: 460364 - DNA, 499 bp, Homo sapiens; identical to SEQ ID NO: 452982
  misc_feature: HEFZJCU01B560E.11.71.G05.1.454.heavy.3.raw

SEQ ID NO: 460365 - DNA, 482 bp, Homo sapiens; identical to SEQ ID NO: 444904
  misc_feature: HEFZJCU01C4ZRZ.47.59.F04.1.454.heavy.3.raw

SEQ ID NO: 460366 - DNA, 505 bp, Homo sapiens
  misc_feature: HEFZJCU01DLEC0.48.38.D05.1.454.heavy.3.raw
agtatacatacacgaccggtgctcgatttagtatctgatagttgggtttggggagctctgggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtc

SEQ ID NO: 460367 - DNA, 504 bp, Homo sapiens
  misc_feature: HEFZJCU01C1F11.48.29.C07.1.454.heavy.3.raw
agtatacatacacgaccggtgctcgatttagagtgctacgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggtgccgtattaggaacaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggactacttcctatgtatact

SEQ ID NO: 460368 - DNA, 506 bp, Homo sapiens
  misc_feature: HEFZJCU01D2Q7H.51.12.B01.1.454.heavy.3.raw
cgatcgtatacacgaccggtgctcgatttagtagtgtagattccgcgggggcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcagggtcatcatgaccggggacacgtccatcgccacaacttacatggaactgaccagtctgacatttgacgacacggccgtctattactgtgcgacagaagcggcggacagaggttcgcttactggttcgaggctctccccc

SEQ ID NO: 460369 - DNA, 535 bp, Homo sapiens
  misc_feature: HEFZJCU01B4YIA.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtcctcaagagtcgagtaacgatctcagtggacacgtctaacaatcacctctccctgaggctgagctctgtgacagccgcggacacgggcgtttatactgtgcgagaggggacggacgtacgggtgactacgtgggggtttcgaccccgtgggggcccaggggaaccctggtcaccgtctccgtcacgcctcaaccg

SEQ ID NO: 460370 - DNA, 515 bp, Homo sapiens
  misc_feature: HEFZJCU01AM730.10.59.F04.1.454.heavy.3.raw
catagtagtgcacgaccggtgctcgatttagtacacacacttagggattgggggctttctgagagtcatggacctcctgtgcaagaacatgaatcacctgtggttcttcctcctgctggtggcggcccccagatgggtcctgtcccagctgcagctgcatgagtcgggcccaggactggtgaggccttcggataccctgtccctcagttgcgctgtctctggtggctccatcaacagtggtgacaactggtggggctgggtccgccagcccccagggatgggactggagtggattggcctttacacattatagtgggactacccactacaacccgtccctcaggagtcgagtcaccatctcactagacacgtccaggaatcacctctccctgacggtgacctctgtgaccgccgcggacacggccgtgtattattgtgcgagagaccccgctgaagattcctcaatgtactttgaccactggggccagggagccctggtccaccgtctcctcacg

SEQ ID NO: 460371 - DNA, 500 bp, Homo sapiens
  misc_feature: HEFZJCU01CU7LY.11.73.G07.1.454.heavy.3.raw
cgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggaggcttggtacagcctggacggtccctgagactctcctgtgcagcctctggatacatcttcaaaagtttcgaaatgagctgggtccgccaggctcctgggaaggggccggagtggatttcatacatcagtagtagtggtaacaccttgtactatgcagactctgtgaagggccgattcaccatctccagagacaacgccaagaattcactgtttctgcaaatgaacagcctgagagacgaggatacggctatttactattgtgcgcgatcgacagaaaaagcggtaggcctatc

SEQ ID NO: 460372 - DNA, 494 bp, Homo sapiens
  misc_feature: HEFZJCU01CKX7M.53.80.H03.1.454.heavy.3.raw
cgcgtatacacacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagttcagggcagggtcaccatgaccagggacacgtccatcagcactgcctacatggagctgaccaggctgaatttgaggacacggccatttattactgtgcaaggaacagcataatgactcgtccccggacttcg

SEQ ID NO: 460373 - DNA, 505 bp, Homo sapiens
  misc_feature: HEFZJCU01BMBW2.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgagggccgattcaccatctccagagacgattccaagaacacgttgtatcttcaatgaacagcctgacagtcgacgacacggccatgtattttgtgcgagcgacccggggctcctcaatggctttcattacg

SEQ ID NO: 460374 - DNA, 504 bp, Homo sapiens
  misc_feature: HEFZJCU01CCAZ8.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttatgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggacg

SEQ ID NO: 460375 - DNA, 495 bp, Homo sapiens; identical to SEQ ID NO: 455563
  misc_feature: HEFZJCU01AFOTZ.51.35.D02.1.454.heavy.3.raw

SEQ ID NO: 460376 - DNA, 506 bp, Homo sapiens
  misc_feature: HEFZJCU01DEKS1.21.4.A04.1.454.heavy.3.raw
  modified_base (422)..(422): a, c, t, g, unknown or other
tcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttgatccagcctggagggtccctgagactctcctgtgcagcctctgcattcaccttcagtgaccacaacatggactgggtccgccaggctccagggaaggggctggagtgggtcggccgtattacaaggaaagctaacagttacagtacagaatacggcgcgtccgtgaaaggaaggttcaccatctcaagagatgattcaaagaactnactgtatctgcaaatgaacagcctagaaaaccgaggacacggccgtgtattattgtggtagacaaagagtggatgtggtggtag

SEQ ID NO: 460377 - DNA, 513 bp, Homo sapiens
  misc_feature: HEFZJCU01DQTUT.52.34.D01.1.454.heavy.3.raw
cgcagtacgacacgaccggtgctcgatttagatcgtctgtgttgggtttggggagctctgggagaggagcccagcactgggattccgaggtgtttccattcagtgatctgcactgaacacagaggactcgccatggagtttgggctgagctgggttttccttgttgctattttaaaaggtgtccagtgtggagtgcaggtggtggagtctgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagcccgtaacttcg

SEQ ID NO: 460378 - DNA, 379 bp, Homo sapiens; identical to SEQ ID NO: 444450
  misc_feature: HEFZJCU01EJFB5.47.77.G11.1.454.heavy.3.raw

SEQ ID NO: 460379 - DNA, 493 bp, Homo sapiens
  misc_feature: HEFZJCU01CRN4D.47.55.E11.1.454.heavy.3.raw
agctcacgtacacgaccggtgctcgatttagcactcgcacgttgggtttgggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgcttcggtcgcgggacttc

SEQ ID NO: 460380 - DNA, 481 bp, Homo sapiens
  misc_feature: HEFZJCU01CPSKE.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttcccctggcgccctgctccaggagcaccctccgagagcacagcggccctgggctgcctggtcaaggactacttccacgcgtatgt

SEQ ID NO: 460381 - DNA, 518 bp, Homo sapiens; identical to SEQ ID NO: 451751
  misc_feature: HEFZJCU01BDAUU.9.34.D01.1.454.heavy.3.raw

SEQ ID NO: 460382 - DNA, 501 bp, Homo sapiens
  misc_feature: HEFZJCU01DU0FP.48.59.F04.1.454.heavy.3.raw
agtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggcccgagcgcagtggcttttgatgcctttgatatgtgggccgaaggacaagtgtcaccgt

SEQ ID NO: 460383 - DNA, 506 bp, Homo sapiens
  misc_feature: HEFZJCU01B2BJ3.10.12.B01.1.454.heavy.3.raw
catagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatctgggggaggcgtggtccagccagggaggtccctgagactctcctgtgcagcctctggattgaggttcaataactatgctatgcactgggtccgccaggctccagggaaggggctggaatggatgacagttatttcacacgatgcaaccaaaacatactacgcggagttcgtgagggccgctgcatcgtctccagagacaattcgaagaacactctgtacctgcaaatgaacagtctgagagccgaggacacggccgtctacttttgtgcgactagaagtgggagctataggggatttgattccg

SEQ ID NO: 460384 - DNA, 517 bp, Homo sapiens; identical to SEQ ID NO: 448924
  misc_feature: HEFZJCU01DV4UN.7.78.H01.1.454.heavy.3.raw

SEQ ID NO: 460385 - DNA, 494 bp, Homo sapiens
  misc_feature: HEFZJCU01DKN49.48.71.G05.1.454.heavy.3.raw
agtatacatacacgaccggtgctcgatttagtgtcgtcgcaagagagagggggatcacataacaaccacattcctcctctaaagaagtccctgggagcacagctcttcaccatggactggacctggaggttcctctttgtggtggcagcagcaacaggtgtccagtcccaggtgcggctggaacaatctggggccgaagtgaggaagcctgggtcctcagtgaagatctcctgcctggcctctggaggcaccttcaatcactatgctttcaactgggtgcgacaggtccctggacaaggacttgtgtggatggggggattcatccctatgtttaagagaatcaggcgtgctgagaagttcgaggacagagtcacctttatggcggacgaatcctcgagcacagtctatatggatctggccagcctgaagtctgaagacacgggcatatattttctgttgcgacagatggtcgtggattctcgtctgcttatgga

SEQ ID NO: 460386 - DNA, 492 bp, Homo sapiens; identical to SEQ ID NO: 446191
  misc_feature: HEFZJCU01BF40K.11.38.D05.1.454.heavy.3.raw

SEQ ID NO: 460387 - DNA, 500 bp, Homo sapiens; identical to SEQ ID NO: 446033
  misc_feature: HEFZJCU01D4ODQ.11.27.C05.1.454.heavy.3.raw

SEQ ID NO: 460388 - DNA, 564 bp, Homo sapiens
  misc_feature: HEFZJCU01CV172.49.38.D05.1.454.heavy.3.raw
agtcgagagacacgaccggtgctcgatttagtatctgatagttgggtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgtctttagttaccggttccgtaccccgtcgggggcccgaggggacgcccgtcgggtccgacccggttccttcccttccgacgtcctttcccaacccgaaacggggccccaacgtccgggttccctttccccccgtcggtccggtccccg

SEQ ID NO: 460389 - DNA, 371 bp, Homo sapiens; identical to SEQ ID NO: 444919
  misc_feature: HEFZJCU01B0GPF.3.1.A01.1.454.heavy.3.raw

SEQ ID NO: 460390 - DNA, 531 bp, Homo sapiens
  misc_feature: HEFZJCU01D4D4V.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaagggcccatcggtcttcccctggccaccctcctccaagagcacctctggggc

SEQ ID NO: 460391 - DNA, 529 bp, Homo sapiens; identical to SEQ ID NO: 455700
  misc_feature: HEFZJCU01BD258.14.35.D02.1.454.heavy.3.raw

SEQ ID NO: 460392 - DNA, 516 bp, Homo sapiens
  misc_feature: HEFZJCU01CZ7IS.13.59.F04.1.454.heavy.3.raw
tcacgtactacacgaccggtgctcgatttagtacacacacttagggattggggggaagaggaagactgacggtcctgccacaggtggtgctgggcacggtggaatcctgctccccaccatggacatactttgttccacgctcctgctactgactgtcccgtcctgggtcttgtcccaggtcaccttgagggagtctggtcctgcgctggtaaaacccaaacaggccctcacagtgacctgcaccgtctctgggctttcactcaatagaagtacagtgtgtatgagttggattcgtcagtccccagggaaggccctggagtggcttgcacgcattgattgggatgatgatcaaaaatattacaacacatctatgaagaccaggctcaccatctccaaggacatcttcacgagccaagtggtccttagaatgaccaactttggaccctgtggacacaggcacctattattgtgcacatcaaaagagatttctactacggtgtggacgtctggggccaa

SEQ ID NO: 460393 - DNA, 388 bp, Homo sapiens
  misc_feature: HEFZJCU01EIYZJ.52.34.D01.1.454.heavy.3.raw
cgcagtacgacacgaccggtgctcgatttagatcgtctgtgttggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttccccctggcaccctcctccaagagcacctctgggggcacagcggccctgggctgcctggtcaaggactacttcctatacgatcg

SEQ ID NO: 460394 - DNA, 511 bp, Homo sapiens
  misc_feature: HEFZJCU01A67H0.9.14.B03.1.454.heavy.3.raw
tgatacgtctcacgaccggtgctcgatttagtgtgagtagtttgggtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctgggcctgcctggtcaaggactacgttccagacgtatca

SEQ ID NO: 460395 - DNA, 400 bp, Homo sapiens; identical to SEQ ID NO: 444452
  misc_feature: HEFZJCU01CGNBF.47.24.C02.1.454.heavy.3.raw

SEQ ID NO: 460396 - DNA, 513 bp, Homo sapiens
  misc_feature: HEFZJCU01DS05I.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggctttttcttgtggctatttttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaaatgaacagcctgagagccgacgacacggccatatattactgtgcgaaagcaaccggcagttagtcacccatactactttgactactggggccg

SEQ ID NO: 460397 - DNA, 500 bp, Homo sapiens
  misc_feature: HEFZJCU01A2CK3.13.12.B01.1.454.heavy.3.raw
tcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaagggccgattcgccatctccagagacaattccaggaacacgctgtacctggagatggacggcctgagacctgacgacacggcaatttattactgtgcgagggtttatgtgttggaacgtggtacaccggaaaactggttcgaccctggggccagggaaccctggtcgtcgtctcgtctgcctccaccaagggcccatcggtcttccccctggcgccctgctccaggagcacctccgagagcacagcggccctgggctgcctggtcaaggactacttcctagtacgtga

SEQ ID NO: 460398 - DNA, 476 bp, Homo sapiens; identical to SEQ ID NO: 452095
  misc_feature: HEFZJCU01EUPJG.16.10.A10.1.454.heavy.3.raw

SEQ ID NO: 460399 - DNA, 492 bp, Homo sapiens
  misc_feature: HEFZJCU01CBESW.18.70.G04.1.454.heavy.3.raw
  modified_base (414)..(414): a, c, t, g, unknown or other
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaaggcccatcggtcttcccctggcnccctgctccaggagcacctcccgagagcacagcggccctgggctcgcctggtcaaggactacttcccactacctcgta

SEQ ID NO: 460400 - DNA, 486 bp, Homo sapiens
  misc_feature: HEFZJCU01CTCI7.49.35.D02.1.454.heavy.3.raw
  modified_base (454)..(454): a, c, t, g, unknown or other
agtcgagagacacgaccggtgctcgatttagcacacgatagttgggtttggggctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgacaatgaacaggctgagagctagaanacacggctgtatattactgtgacgtaacttaa

SEQ ID NO: 460401 - DNA, 513 bp, Homo sapiens; identical to SEQ ID NO: 446699
  misc_feature: HEFZJCU01AW10R.12.25.C03.1.454.heavy.3.raw

SEQ ID NO: 460402 - DNA, 371 bp, Homo sapiens; identical to SEQ ID NO: 444435
  misc_feature: HEFZJCU01CHL7U.3.42.D09.1.454.heavy.3.raw

SEQ ID NO: 460403 - DNA, 504 bp, Homo sapiens
  misc_feature: HEFZJCU01C7510.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttcccctggcgccctgctccagagcacctccgagagcacagcgccctgggctgcctggtcaaggactactccgagtgcgtct

SEQ ID NO: 460404 - DNA, 527 bp, Homo sapiens
  misc_feature: HEFZJCU01DSV3D.22.11.A11.1.454.heavy.3.raw
acatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccagggaaggggctggagtggatctcagttatttatctcggtggtaacacatactacgcagactccgtggagggccgattcaccatctccagagacaattccaagaacacggtgtatcttcaaatgaacagcctgagagccgatgacacggccgtgtattactgtgtgagatcaaaattccaagccgcgggggtcacccaaattgactactggggccgagggaaccctggtcaccgtctcctcagcctccaccaagggcccatcggtcttccccctggccgccctgctccac

SEQ ID NO: 460405 - DNA, 512 bp, Homo sapiens
  misc_feature: HEFZJCU01EMDXE.49.38.D05.1.454.heavy.3.raw
agtcgagagacacgaccggtgctcgatttagtatctgatagttgggtttgggggaggcgtggtccagcctgggaggtccctgagactctcctgtgtagtctctggattcaccttcagggtctatgacatgcactgggtccgccaggctccaggcaaggggctggagtgggtggcagttatatcaaatgatgcaagtaacaaatactatgtagactccgtgaagggccgattcaccatctccagagacaattccaagaatacgctgtatctgcacatgaacagcctgagagccgaagacacgggtgtttattactgtgcgaacttaattacggaggacaacggtaacccccgtccgcacggtacggacgtctggggccaagggaccacggtcaccgtctcctcagcctccaccaagggcccatcggtcttcccctggcaccctcctccaagagcacctctgggggcacagcggccctgggctgcctggtcaaggactacttcctctctcgact

SEQ ID NO: 460406 - DNA, 513 bp, Homo sapiens
  misc_feature: HEFZJCU01E0OE6.11.67.G01.1.454.heavy.3.raw
cgagagataccacgaccggtgctcgatttagagtatacatattggggggggcttggtgcagccgagggggtccctgagactctcctgtgtaggctctggattcagttttagcagctacgccatgacctgggtccgccaggctccagggaaggggctggagtgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtccagatattgcactggtggcaactgctacgacgcctactattatcaccacatggacgtctgggggcaaagggaccacggtcatcgtctcctcagcctccaccaagggcccatcggtcttccccctcggcaccctcctccaagagcacctctgggggcacagcggccctgggctgcctggtcaaggactac

SEQ ID NO: 460407 - DNA, 513 bp, Homo sapiens
  misc_feature: HEFZJCU01D2JP1.48.35.D02.1.454.heavy.3.raw
agtatacatacacgaccggtgctcgatttagcacacgatagttgggtttggggggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaaccccgtcctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgagggccgattcgccttctccagagacaattccaagagcacggttcatctgcaaatgagcgccctgagacctgacgacacggctgtctattactgtgcgagagggcgtccgagtttaaccacgccggtcggggagggata

SEQ ID NO: 460408 - DNA, 378 bp, Homo sapiens
  misc_feature: HEFZJCU01D62IP.3.59.F04.1.454.heavy.3.raw
agacgcactccacgaccggtgctcgatttagtacacacacttagggactggagtggatagggaatacttattacgatgggcgcaccaactataacgtcttactcaggagtcgggtcaccatatcagtggacacgtccaacaacaacttctccctgaggctgacctctgtgaccgccgcagacacggccatttatcactgtgggagacaatgtagtgggggtgactgcccgaatactggggccagggaacccgggtcaccgtctcctcagcctccaccaagggcccatcggtcttccccctggcgccctgctccaggagcacctccgagagcacagcggccctgggctgcctggtcaaggactacttccgagtgcgtct

SEQ ID NO: 460409 - DNA, 517 bp, Homo sapiens
  misc_feature: HEFZJCU01C2SOO.13.75.G09.1.454.heavy.3.raw
tcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtgggtccttcagtggttactactggagctggatccgccagcccccacgggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggccccgaaagaggaaagtggctacgatttgggaagtactactacatggacgtctggggcaagggaccacggtcaccgtctcctc

SEQ ID NO: 460410 - DNA, 490 bp, Homo sapiens
  misc_feature: HEFZJCU01EF5M6.40.85.H08.1.454.heavy.3.raw
tctagcgactcacgaccggtgctcgatttagtatcactcagtcgcggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctcgtgacgacacggccatgtattactgtggaagagacgttggtggctaccgcggggctgaccactggggccagggaaccctggtcaccgtctcctcagcctccaccaagggcccatcggtcttcccctggcgccctgctccaggagcacctccgagagcacagcggccctgggctgcctgtcaaggactacttccagtcgctaga

SEQ ID NO: 460411 - DNA, 525 bp, Homo sapiens
  misc_feature: HEFZJCU01AZISC.47.6.A06.1.454.heavy.3.raw
agctcacgtacacgaccggtgctcgatttagatctactgacagcacacaagggggggaaatactttctgagagtcctggacctcctgtgcaagaacatgaaacatctgtggttcttccttctcctggtggcagctcccacatgggtcctgtcccaggtgcagctgcaggagtcgggcccaggactggtgaagccttcggagaccctgtccctcacttgcactgtctctggtggctccatcaggagttactactggacctggcttcggcagtccccagggaagggactggagtggattgggtataattattacagtgggaccaccaactacaacccctccctcaagagtcgagtcaccatatcaatagacacgtcgaagaaccagttctccctgaagttgaactcagtgaccgctgcggacacggccgtgtattactgtgcgagccacaccgattacgattttggagtggccttgataactggggccaggggatcctggtcaccggtctcctcagcctccaccaac

SEQ ID NO: 460412 - DNA, 544 bp, Homo sapiens
  misc_feature: HEFZJCU01ESSJ7.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcccccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaaagtaatggctgttgtttagttggggccaggggagccctgggtccaccggtt

SEQ ID NO: 460413 - DNA, 482 bp, Homo sapiens
  misc_feature: HEFZJCU01EGOOP.11.23.C01.1.454.heavy.3.raw
cgagagataccacgaccggtgctcgatttagtacacgtgattagggattgggggcagggtgtacacctgtggttctcggggctgccctttggctttggagatggttttctcgatggggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttccccctggcaccctcctccaagagcacctctggggcacagcggccctgggctgcctggtcaaggactacttccgtatctct

SEQ ID NO: 460414 - DNA, 515 bp, Homo sapiens
  misc_feature: HEFZJCU01DXNUP.40.9.A09.1.454.heavy.3.raw
tctagcgactcacgaccggtgctcgatttagcgagacgcgcaggggggtctcagagaggagccttagccctggactccaaggcctttccacttggtgatcagcactgagcacagaggactcaccatggaattggggctgagctgggttttccttgttgctattttagaaggtgtccagtgtgcggtgaaactagcggagtctgggggaggcttggtccagcctggggggtccctaagactctcctgcgcagcctctggattcatgtttagtgattattggatggcttgggtccgtcaggctccagggaaagggctggagtttgtggccaagatgaaccacgacggaaatgagaaaaactatgcggactctgtgaagggccgattcaccatttccagagacaacgccaagaagtcactctctctacacatgaccagcctgacagccgagacacggctgtttattactgtgcgagagatggcactcggggcggtgactttgactactggggccaggg

SEQ ID NO: 460415 - DNA, 477 bp, Homo sapiens; identical to SEQ ID NO: 444659
  misc_feature: HEFZJCU01E0TRC.16.10.A10.1.454.heavy.3.raw

SEQ ID NO: 460416 - DNA, 532 bp, Homo sapiens
  misc_feature: HEFZJCU01DRLNQ.51.26.C04.1.454.heavy.3.raw
cgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgttattactgtgtgcgatccgacctcactggtacggggagttacttcctccgcaacggtatggacgtctggggccaaggggaccacggtcaccgtctccttagcctccaccaagggcccatcggtcttccccctggcaccctcctccagagcacctctc

SEQ ID NO: 460417 - DNA, 510 bp, Homo sapiens
  misc_feature: HEFZJCU01CWUPR.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagcctccaggcaagggattggagtgggtggcagttgtttcatctggagggcagtgttcaatggtatgcagactccgtgaagggccgattcaccatctccagagacaattccaggaacacaatgtatttggagctgaacagcctaagtcctgaggacacgggcgtatactactgtacgaagggagggggaaccgaggcggagtacaagtactctt

SEQ ID NO: 460418 - DNA, 503 bp, Homo sapiens; identical to SEQ ID NO: 449697
  misc_feature: HEFZJCU01DOOLV.10.23.C01.1.454.heavy.3.raw

SEQ ID NO: 460419 - DNA, 531 bp, Homo sapiens
  misc_feature: HEFZJCU01CHHY4.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggatacagtggcagctccaagtactactttgacttctggggccagggaaccctggtcaccgtctcctcagcctccaccaacgggcccatcggtcttccccctggccgccctgcctccaggagcacctccgagacg

SEQ ID NO: 460420 - DNA, 505 bp, Homo sapiens
  misc_feature: HEFZJCU01BRRTP.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcccgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttccccctggcgccctgctccaggagcacctccgagagcacagcggccctgggctgcctggtcaaggactacttcccactact

SEQ ID NO: 460421 - DNA, 519 bp, Homo sapiens
  misc_feature: HEFZJCU01D7AZ5.48.41.D08.1.454.heavy.3.raw
agtatacatacacgaccggtgctcgatttagtcacgcgagaaagggaaagggggctttctgagagtcagggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggttggatccgccagcccccagggaaggggctggagtggattgggagtatgcactatagtgggagcacccactacaccccgtccctcaagagtcgagtcaccatatccgtagacacgtccaagaatcagttctccctgaagctgacctctgtgaccgccgcagacacggctgtttattactgtgtgagacggggtgccccaagaaaagtgttttatcctgggccagggaaccctggtcaccgtctcctcagcctccaccaaggccc

SEQ ID NO: 460422 - DNA, 503 bp, Homo sapiens
  misc_feature: HEFZJCU01B1SE6.52.35.D02.1.454.heavy.3.raw
cgcagtacgacacgaccggtgctcgatttagcacacgatagttgggtttgggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccggacaagggcttgtttggatgggatggatcaacgctggcaatggtaacacaaaatattcacagaagttccagggcagagtcaccatcaccagggacacatccgcgagcacagcctacatggagttgagcagcctgagaaatgaagacaaggctgtatattactgtgcgagaggggaaatgggtaaggatttttggagtaattattatcctggcggtgcgg

SEQ ID NO: 460423 - DNA, 495 bp, Homo sapiens
  misc_feature: HEFZJCU01D73BE.4.19.B08.1.454.heavy.3.raw
agcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactctgggggaggcgtggtccagcctgggaggtccctgagactctcctgtatagcctctggattcaccttcggcagttatgctatgcactgggtccgccaggctccaggcaaggggttggagtgggtggcaggcaatatcatatgatggaagtgataaatattacatagagtccgtgaagggtcgattcaccatctccagagacaatcgcaagaacacactgtatctggaaatgaccagcctgagaggtgacgacacgggtgtttatactgtgcgcgggatagaggctcatcgtggatacaa

SEQ ID NO: 460424 - DNA, 520 bp, Homo sapiens; identical to SEQ ID NO: 455235
  misc_feature: HEFZJCU01B8F7U.13.76.G10.1.454.heavy.3.raw

SEQ ID NO: 460425 - DNA, 507 bp, Homo sapiens
  misc_feature: HEFZJCU01C1YAZ.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgttgttttggccggtgactactggggccagggcaccctggtcaccgtctcctcagcttccaccaagggcccatcggtcttcccctggcgcctgctccaggagcacctcgtggggcacgagcggccctgggctgcctggtcaggactactcccata

SEQ ID NO: 460426 - DNA, 497 bp, Homo sapiens
  misc_feature: HEFZJCU01CD5RU.49.45.E01.1.454.heavy.3.raw
agtcgagagacacgaccggtgctcgatttagtgagtcagtaagggaaaggggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcacttatatcctatgatggaagcaataagcactacgcagagtccgtgaagggccgattgaccatctccagagacaactcgaagaatacggttcttctacaaatgaacagcctgagagctgaggacacggctatcttttactgtgcgagagggaactcgattacagcag

SEQ ID NO: 460427 - DNA, 521 bp, Homo sapiens
  misc_feature: HEFZJCU01CXKBF.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccactaggtttgactacgtgggggccaggggaagcttggtccaccggtctcctca

SEQ ID NO: 460428 - DNA, 483 bp, Homo sapiens; identical to SEQ ID NO: 444924
  misc_feature: HEFZJCU01B8M3I.10.35.D02.1.454.heavy.3.raw

SEQ ID NO: 460429 - DNA, 511 bp, Homo sapiens
  misc_feature: HEFZJCU01CNTEA.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcaggttgtttcatctgagggcagtgttcaatggtatgcagactccgtgaagggccgattcaccatctccagagacaattccaggaacacaatgtatttggagctgaacagacctaagtcctgaggacacgggcgtatactactgtacgaaggaggggggaaccgagcgggagttcaagtactcttt

SEQ ID NO: 460430 - DNA, 427 bp, Homo sapiens; identical to SEQ ID NO: 444708
  misc_feature: HEFZJCU01ECBT8.9.34.D01.1.454.heavy.3.raw

SEQ ID NO: 460431 - DNA, 523 bp, Homo sapiens
  misc_feature: HEFZJCU01A9BQT.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatccggtcttcccctggccg

SEQ ID NO: 460432 - DNA, 530 bp, Homo sapiens
  misc_feature: HEFZJCU01AI7GA.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtgaattgactactggggccagggaaccctggtcaccgtctcctcagcctccaccaaggg

SEQ ID NO: 460433 - DNA, 511 bp, Homo sapiens
  misc_feature: HEFZJCU01CHKFS.49.81.H04.1.454.heavy.3.raw
agtcgagagacacgaccggtgctcgatttagtagtgtagattcgcgggggggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgtagtctctgggttcaccttcgagggtctatgacatgcactgggtccgccaggctccaggcgaggggctggagtgggtgcagttatatcatatgatgggaagcaagatatactatgtagactccgtgaagggccattcatcatctccagagacaactccgagaacacgctgtatctgcaaatgaacaggctgagagctagaagacacggctttatattactgtgcgaacttaatcacggaggacaacggtcgacccccgtcgccg

SEQ ID NO: 460434 - DNA, 526 bp, Homo sapiens; identical to SEQ ID NO: 452446
  misc_feature: HEFZJCU01AW44U.9.33.C11.1.454.heavy.3.raw

SEQ ID NO: 460435 - DNA, 525 bp, Homo sapiens
  misc_feature: HEFZJCU01D4KQ5.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacattttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaaggcccatcggtcttcccctggcgccctgctccaggagcacctccgagagcacagcggccctgggctgcctggtcaaggacacttcacg

SEQ ID NO: 460436 - DNA, 539 bp, Homo sapiens
  misc_feature: HEFZJCU01AV3QW.48.44.D11.1.454.heavy.3.raw
agtatacatacacgaccggtgctcgatttagcgcagtacgaaggggctgggagaggagctccagccttgggactcccagctgtctccactcggtgatcggcactgaatacaggagactcaccatggagtttgggctgagctgggttttccttgttgctattttaaaaggtgtccagtgtgaggtgcagttggtgcagtccgggggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctcgaaaaccgaggaacacggtccgtttattattgtacttctggaggtggacgggaaccgctggctagttggggccac

SEQ ID NO: 460437 - DNA, 466 bp, Homo sapiens
  misc_feature: HEFZJCU01DTKS6.48.7.A07.1.454.heavy.3.raw
agtatacatacacgaccggtgctcgatttagcacgtgtcgcaggggcagggtgtacacctgtggttctcggggctgtcctttggttttggagatggttttctcgatgggggctgggatggctcaacgctgacgatggtcaaacaaaatattcacagcaattccagggcagactctcccttaccagggacacttccgcgaacacaggctacatgtttttgagcagactgacatctaaagacacggctatttactactgtgcgagaggcggattttgtcggcgtggtgattgttacagtcagaatcgtcgattgtggttcgacccctggggccagggaaccctgctctccgtctcctcagcttccaccaagggcccatcggtcttcccctggcgccctgctccaggagcacctctgggggcacagcggccctgggctgcctggtcaaggactacttcctatgtatact

SEQ ID NO: 460438 - DNA, 523 bp, Homo sapiens; identical to SEQ ID NO: 446270
  misc_feature: HEFZJCU01CFK9X.12.40.D07.1.454.heavy.3.raw

SEQ ID NO: 460439 - DNA, 539 bp, Homo sapiens
  misc_feature: HEFZJCU01BFXYM.7.78.H01.1.454.heavy.3.raw
cgtgtctctacacgaccggtgctcgatttagtgtgagtagtttgggtttggggacccaacaaccacaccccccctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccaggggaaccctggtcaccgtctcctcagcctccaccaagggcccacg

SEQ ID NO: 460440 - DNA, 516 bp, Homo sapiens
  misc_feature: HEFZJCU01AOOYL.4.33.C11.1.454.heavy.3.raw
agcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatgaacagcctgaagaccgaggacacagccgtctattactgtgttagggtagttttacgtatttttggagtggatattaa

SEQ ID NO: 460441 - DNA, 372 bp, Homo sapiens; identical to SEQ ID NO: 444727
  misc_feature: HEFZJCU01EF24N.3.42.D09.1.454.heavy.3.raw

SEQ ID NO: 460442 - DNA, 483 bp, Homo sapiens; identical to SEQ ID NO: 444639
  misc_feature: HEFZJCU01ED79T.11.23.C01.1.454.heavy.3.raw

SEQ ID NO: 460443 - DNA, 517 bp, Homo sapiens
  misc_feature: HEFZJCU01AERZE.51.17.B06.1.454.heavy.3.raw
cgatcgtatacacgaccggtgctcgatttagtcgatagtgaaggggcagtgactcctgtgccccaccatggacacactttgctccacgctcctgctgctgaccatcccttcatgggtcttgtcccagatcaccttgaaggagtctggtcctacactggtgaaacccacacagaccctctcgctgacctgcgccttctctgggttctcactcagcagtagtggagtgggtgtgggctggatccgtcagcccccaggaaaggccctggagtggggttgcactcatttattggaatgatgaaagccgctacagcccatctctgaagagcaggctcaccatctcgaggggcaggtccgaaaaccaggtgatccggttacgatgagtaacttggaccctgtggacacagccacatattactgtgcacacaggttcggcgtattttggagtggttattcaaaccctacttcgacttcgtggggcccgggaatcctggtcaccgtctcctcagcctccaccaac

SEQ ID NO: 460444 - DNA, 412 bp, Homo sapiens; identical to SEQ ID NO: 444705
  misc_feature: HEFZJCU01DF6GV.51.60.F05.1.454.heavy.3.raw

SEQ ID NO: 460445 - DNA, 513 bp, Homo sapiens
  misc_feature: HEFZJCU01CJ67W.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaatgaacagcctgagagccgatgacacggccgtgtattactgtgcgagagatgggcccacgaacgtttactacgctatggacgtctggggccg

SEQ ID NO: 460446 - DNA, 525 bp, Homo sapiens
  misc_feature: HEFZJCU01DN9QU.4.59.F04.1.454.heavy.3.raw
agcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtgactccataagtagtttcttctggagctggatccggcagcccccagggaagggactggagtggattggccatatctcttacagtgggagcaccaactacaacccctccctcaagagtcgtgtcaccgtgtcaatagacacgtccaagaaccagttctccctgaggctgagctctgtgaccgccgcggacacggccgtgtatttctgtgcgagatctttcgattttggagtggtaaccccttggctactgggccagggaccctggtcaccgtctcttcagcctccaccaagggccc

SEQ ID NO: 460447 - DNA, 525 bp, Homo sapiens
  misc_feature: HEFZJCU01B9BMR.48.73.G07.1.454.heavy.3.raw
agtatacatacacgaccggtgctcgatttagctctacgctcagggcacgaccggtgctcgatttagtgatagagcgtaacaacagagggggagccccagacctgggattcccagctgtttctgcttgctgatcaggaccgcacacagagagctcaccatggagttggggctgacctgggttttccttgtggctactttaagaggtgtcctgtgtgaggtgcacctgctggagtccgggggaggcttagttcggccgggggagtccctgagactcgcctgtgtagtgtctggattcaccttcaggaattacgacatggactgggtccgccaagctccagggaagggctggagtgggtctcaaacgtgaacgttgatggcgggatcacaaaatacgcggactccgtgaaaggccgcttcaccgtctccagagacaacggcgagaatactctgtatttgcagatgagaaatctgagaggcgaggacaccgcgctttattattgtacaacgtcgttttacttttctaat

SEQ ID NO: 460448 - DNA, 512 bp, Homo sapiens; identical to SEQ ID NO: 447906
  misc_feature: HEFZJCU01EFBN3.17.33.C11.1.454.heavy.3.raw

SEQ ID NO: 460449 - DNA, 504 bp, Homo sapiens
  misc_feature: HEFZJCU01EBH2E.22.36.D03.1.454.heavy.3.raw
acatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacagccgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattaccgaaaacacagtgaatctgcaaatgtacagcctcagcgccgaggacacggccgtctacttctgtgcgaaagacctctattttggccgcggccgactac

SEQ ID NO: 460450 - DNA, 381 bp, Homo sapiens; identical to SEQ ID NO: 445431
  misc_feature: HEFZJCU01EE007.3.70.G04.1.454.heavy.3.raw

SEQ ID NO: 460451 - DNA, 516 bp, Homo sapiens
  misc_feature: HEFZJCU01BU7WD.4.33.C11.1.454.heavy.3.raw
agcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaagggctggagtgggtaggtttcattagagccatggcttatgctgggacaacagaatacgccgcgtctgtgaaaggcagattcatcatctcaagagatgattccaacggcatcgcctatctgcagatgaacagcctgaagaccgaggacacagccgtctattactgtgttagggtagttttacgtagtttttggagtggatattaa

SEQ ID NO: 460452 - DNA, 542 bp, Homo sapiens
  misc_feature: HEFZJCU01CX2R0.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagtctgggggaggcttggtaaagccgggggggtcccttagactcccctgtacagcctctggattcactttcagtaaggcctggatgaactgggtccgccaggctccaggaaaggggctggagtgggttggccgtattaaaccaaaactgatggtgggacaacagactacgctgcacccgtgaaagggcagattcaccatctcaagagatgattcaaaaagcacgctgtatctgcaaatgaacagcctgagaaccgaggacacagccgtgtattactgtaccacatcccctgaaagcgtcaactactactactacggtatggacctctggggccaagggacccg

SEQ ID NO: 460453 - DNA, 515 bp, Homo sapiens
  misc_feature: HEFZJCU01CWCNZ.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccgattcaccatctccagagacgattccaagaacacgttgtatcttcaaatgaacagcctgacagtcgacgacacggccatgtattttgtgcgagcgacccggggctcctcaatggctttcattactggggccac

SEQ ID NO: 460454 - DNA, 502 bp, Homo sapiens
  misc_feature: HEFZJCU01CWSHM.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggccatcggtcttcccctggcaccctcctccaagagcacctctgggggcacagcgccctggctgcctggtcaaggctacttccgagtagtaca

SEQ ID NO: 460455 - DNA, 528 bp, Homo sapiens
  misc_feature: HEFZJCU01CN0TT.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacgggctgtttatactgtacgaaagagggggatacagtggcagctccaagtactactttgacttctggggccagggaaccctggtcaccgtctcctcagcctccaccaagggcccatcggtcttcccctggcgccctgctccaggagcacctccgacgacg

SEQ ID NO: 460456 - DNA, 497 bp, Homo sapiens
  misc_feature: HEFZJCU01D76AQ.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtctcccctggcgccctgctccaggagcacctccgagagcacagcgccctggctgcctggtcaaggctacttccacta

SEQ ID NO: 460457 - DNA, 490 bp, Homo sapiens; identical to SEQ ID NO: 446494
  misc_feature: HEFZJCU01CPRMF.11.13.B02.1.454.heavy.3.raw

SEQ ID NO: 460458 - DNA, 520 bp, Homo sapiens
  misc_feature: HEFZJCU01A2EPR.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccatgactacatgggatggatcaacaccgacactgggaaccccacctatgcccaggccttcacagggcggtttgtcttctccatggatacctctgtcgggacggcttatctgcagataaccaaccttcaacctgacgacactgccgttttatttttgtacgagagcgtcgtctgtcagtggaattgactactggggccagggaaccctggtcaccgtctcctcagcctccaccaagggcccatcggtcttcccctggcaccctcctccaagagcacctctgggggcacagcggccctgggctgcctggtcaaggactacttcctagagacacg

SEQ ID NO: 460459 - DNA, 503 bp, Homo sapiens
  misc_feature: HEFZJCU01DXN01.10.23.C01.1.454.heavy.3.raw
catagtagtgcacgaccggtgctcgatttagtacacgtgattagggattggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctggggggaggcttggtacagcctggcaggtccctgagactctcctgtgcagcctctggattcagctttgatgaatatgccatggactgggtccggcaagttccagggaagggcctggagtgggtctcaggtattgattggaatagtggtaccattgcctatgcggactctgtgaaggccgattcaccatcaccagagacgacgccaggagctccctgtatctccaaatgaacagtctgagacctgaggacacggccttgtattactgtgtaagagggagtcagggtttctaaa

SEQ ID NO: 460460 - DNA, 399 bp, Homo sapiens
  misc_feature: HEFZJCU01C2GXN.19.62.F07.1.454.heavy.3.raw
tactctcgtgcacgaccggtgctcgatttagtagtcgcataaagggaaggggctggagtggattggcgaagtctttcataatggggcaaccaactacaacccgtccctcaggagtcgagtcaccatctcagtagacaagtccgagaaccagttctccctgaccctgaactctgtgaccgccgcggacacggccgtgtattactgtgcgagagagcgtcgcgattacagtcctggtgctggagaacctcttgactattggggccagggaaccctggtcaccgtctcctcagcctccaccaagggcccatcggtcttccccctggcgccctgctccaggagcacctccgagagcacagcggccctgggctgcctggtcaaggactacttcccacgagagta

SEQ ID NO: 460461 - DNA, 405 bp, Homo sapiens; identical to SEQ ID NO: 447426
  misc_feature: HEFZJCU01E1XJY.53.77.G11.1.454.heavy.3.raw

SEQ ID NO: 460462 - DNA, 487 bp, Homo sapiens
  misc_feature: HEFZJCU01CTRKX.40.83.H06.1.454.heavy.3.raw
tctagcgactcacgaccggtgctcgatttagatcacgtgcgtcgcgggggggagaggagcccagcactcgaagtcggcggtgttgccattcggtgatcagcactgaacacagaggactcaccatggagtttgggctgagctgggttttcctcgttgctcttttaagaggtgtccagtgtcaggtgcagttggtggagtctgggggaggcgtggtccagcctgggaggtcactgagactctcctgtgcatcgtccggattcaccttccataaatataacatgcactgggtccgccaggctccaggcaagggactgcagtggctggccactgtctggtcggatgaaagttatgcatactatgcagactctctgaggggccgattcatcatctctagagacaattcgaagaacacggcttatctgcaaatgaacagcctgacagtcgagacacggctgtatatttctgtgcgaatgaggaaggttcgggg

SEQ ID NO: 460463 - DNA, 513 bp, Homo sapiens
  misc_feature: HEFZJCU01BWUYF.52.86.H09.1.454.heavy.3.raw
cgcagtacgacacgaccggtgctcgatttagtgctatagacttgggtttgggctgagcgtgggttttccgtcgttaggctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaaggggacaagtggtcattgtctcttcagcctccaccaagggcccatcggtcttcccccg

SEQ ID NO: 460464 - DNA, 511 bp, Homo sapiens
  misc_feature: HEFZJCU01A9VXY.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacgacggccatgtattactgtaggaagacgtacggttgggtggcgtaccggcggggctcgaccacgtcggggacc

SEQ ID NO: 460465 - DNA, 522 bp, Homo sapiens
  misc_feature: HEFZJCU01C553H.9.78.H01.1.454.heavy.3.raw
  modified_base (459)..(459): a, c, t, g, unknown or other
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttgggccagggaaccctggtcaccgtctcctcagcctccaccagggcccatcgtcttcccctgcgccngctccaggagcacctccgagagcacagcggccctgggctgcctggtcaaggactacttccacg

SEQ ID NO: 460466 - DNA, 511 bp, Homo sapiens
  misc_feature: HEFZJCU01D2MW0.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaatttatgcggactccgtgaacggtcgattcaccatctccagagacaattccaggaacacactgtttctgcaaatgaacagcctgagaattagaggactcgggtatatactactgtgcccgtcgacccctgacctgataaaccggaacgtcggttcgaccccgtggggaccgagggaacccgtggtcaccgtcctcctcc

SEQ ID NO: 460467 - DNA, 535 bp, Homo sapiens
  misc_feature: HEFZJCU01D789F.51.26.C04.1.454.heavy.3.raw
cgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtcgtggggccaagggaccacggtcaccgtctccttagcctccaccaagggcccatcggtcttcccctggccaccctcctccaagagcacctcgtc

SEQ ID NO: 460468 - DNA, 518 bp, Homo sapiens; identical to SEQ ID NO: 444718
  misc_feature: HEFZJCU01AT771.9.34.D01.1.454.heavy.3.raw

SEQ ID NO: 460469 - DNA, 503 bp, Homo sapiens; identical to SEQ ID NO: 446295
  misc_feature: HEFZJCU01ALV55.10.35.D02.1.454.heavy.3.raw

SEQ ID NO: 460470 - DNA, 310 bp, Homo sapiens; identical to SEQ ID NO: 444473
  misc_feature: HEFZJCU01C34K2.18.53.E09.1.454.heavy.3.raw

SEQ ID NO: 460471 - DNA, 507 bp, Homo sapiens; identical to SEQ ID NO: 446637
  misc_feature: HEFZJCU01BELQJ.16.34.D01.1.454.heavy.3.raw

SEQ ID NO: 460472 - DNA, 509 bp, Homo sapiens
  misc_feature: HEFZJCU01C3CHH.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacattattatacagactccgtgaagggccgcttcaccatctccagagacaattccaagaacacggtgtatctgcaaatgaacagcctgagagccgaggacacggccacatattactgtgcgaaagatctcgggctggttccgcggtccgggt

SEQ ID NO: 460473 - DNA, 515 bp, Homo sapiens
  misc_feature: HEFZJCU01EAG3S.4.23.C01.1.454.heavy.3.raw
agcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatgcacagacgttccagggcagagtcaccattaccacagacacatccacgagcacagcctacatggacctgaggagcctgagatttgacgacacgggccatatattactgtgcgagagattggggccgacggaaaccttgactactgggggccaggggaaccctggtcaccgt

SEQ ID NO: 460474 - DNA, 519 bp, Homo sapiens
  misc_feature: HEFZJCU01AIGK0.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctgggccagggaaccctggtcaccgtctcctcagcctccaccaagggcccatcggtcttccccctggcaccctcctccaagagcacctctgggggcacagcggcctgggctgcctggtcaaggactacttccgagtagtactac

SEQ ID NO: 460475 - DNA, 515 bp, Homo sapiens
  misc_feature: HEFZJCU01DOK03.40.27.C05.1.454.heavy.3.raw
  modified_base (496)..(496): a, c, t, g, unknown or other
tctagcgactcacgaccggtgctcgatttagacgcgatcgaagggtttggggggaagaggaagactgacggtcctgtcccagttgcagttgcaggagtcgggcccaggactggtgaagacttcggagaccctgtccctcacgtgcactgtctctggtggctccatccgcaatcgtcgattctattggggctgggtccgccggcccccagggaaggggctggagtggattgcgagcatatattatgatgagagcgccctctacaacccccccctctacaaccctccctcaagagtcgggtcaccatatctatagacacgtccaacagtcaattctccctggacttgacctctgtgaccgccgcagacacggctgtatattcctgtgcgacccacggaggggatggccccaaatctgcctactttgaccactgggccagggaaccttggtcaccgtctcctcagcctccaccaagggcccatcggtcttcccctggcnccctgctcagagcacctcg

SEQ ID NO: 460476 - DNA, 397 bp, Homo sapiens; identical to SEQ ID NO: 448710
  misc_feature: HEFZJCU01CQV3H.7.60.F05.1.454.heavy.3.raw

SEQ ID NO: 460477 - DNA, 508 bp, Homo sapiens
  misc_feature: HEFZJCU01B58PR.48.39.D06.1.454.heavy.3.raw
agtatacatacacgaccggtgctcgatttagtgacatctcgcagttctttggggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctgggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtggggtccgaagggacaatggtcaccgtctcttcagcctcctaaccg

SEQ ID NO: 460478 - DNA, 516 bp, Homo sapiens
  misc_feature: HEFZJCU01EBBIJ.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccaagagcacctctgggggcacagcggcctgggctgcctggtcaaggactacttcctagagaca

SEQ ID NO: 460479 - DNA, 511 bp, Homo sapiens
  misc_feature: HEFZJCU01EL791.52.83.H06.1.454.heavy.3.raw
  modified_base (456)..(456): a, c, t, g, unknown or other
cgcagtacgacacgaccggtgctcgatttagatcacgtgcgtcgcgggggggagaggagcccagcactagaagtcggcggtgtttccattcgctgatcagcactgaacacagaggactcaccatggagtttgggctgagctgggttttcctcgttgctcttttaagaggtgtccagtgtcaggtgcagatggtggagtctgggggaggcgtggtccagcctgggaggtccctgagactctcctgtgtagcctctggattcaccttcagggtctatgacatgcactgggtccgccaggctccaggcaaggggctggagtgggtggcatttatatcaaatgatggaagtaacaaatactatgtagactccgtgaagggccgattcaccatctccagagacaattccaagaatacgctgtatctgcacatgaacagcctgagagccgaagacacgggtntttattactgtgcgaacttaattacggaggacaacggtaaccccgtcgcacggcg

SEQ ID NO: 460480 - DNA, 517 bp, Homo sapiens
  misc_feature: HEFZJCU01C5AAH.17.33.C11.1.454.heavy.3.raw
cgtagactagcacgaccggtgctcgatttagagtgagctcgttgggtttgggctcaactctcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctccaccaaggcccatcggtcttcccctcggcaccctcctccagagcacctctgggggcacagcggcctgggctgcct

SEQ ID NO: 460481 - DNA, 532 bp, Homo sapiens
  misc_feature: HEFZJCU01C6NF8.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcctttttacacctcccttgactttctggggccatcggaaccccggtccg

SEQ ID NO: 460482 - DNA, 517 bp, Homo sapiens
  misc_feature: HEFZJCU01AJ4U4.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctagttaaaactcctactacgtctggacgtctgggccagggacctaac

SEQ ID NO: 460483 - DNA, 534 bp, Homo sapiens
  misc_feature: HEFZJCU01EEL20.48.67.G01.1.454.heavy.3.raw
agtatacatacacgaccggtgctcgatttagagtatacatattgggtttgggggcttttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaactgctttgtctctggaacttctatcaagggtagcagcttctactggggctggatccgccagcccccaggaaaggggctacaatgggttggaaatgtcaattcttatgggcgctcccactacaatccggccctccagagtcgagccctcatatccatagacacgtccaacaaccagttttccctgacgctgacgtctgtgaccgccgcagacacggctgtctattattgtgcgagactaggcttctgtagtggtggtacttgcaacccgggatactactccaacttcggcttggacatctggggccaaggggacctcggtcgtcccg

SEQ ID NO: 460484 - DNA, 506 bp, Homo sapiens
  misc_feature: HEFZJCU01ECQDK.4.57.F02.1.454.heavy.3.raw
agcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttacg

SEQ ID NO: 460485 - DNA, 490 bp, Homo sapiens
  misc_feature: HEFZJCU01CI2HW.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtatcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaaggcccatcggtcttcccctggcgccctgctccaggagcacctccgagagcacagcggccctgggctgcctggtcaaggactacttcccacgagagta

SEQ ID NO: 460486 - DNA, 494 bp, Homo sapiens
  misc_feature: HEFZJCU01DK9QZ.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatcctccagagacaattcccagaacacggtctatctgcacctgaccagcctgagaactgacgacacgtctctctactactgtgcgagagagttgacgagtct

SEQ ID NO: 460487 - DNA, 339 bp, Homo sapiens; identical to SEQ ID NO: 444436
  misc_feature: HEFZJCU01DGTDM.47.38.D05.1.454.heavy.3.raw

SEQ ID NO: 460488 - DNA, 489 bp, Homo sapiens
  misc_feature: HEFZJCU01A2QBX.19.1.A01.1.454.heavy.3.raw
tactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactgggtgcgacaagcccctggacaagggcttgagtggatgggaggaagcatccctttctttgatactccagactacgcacagaagttccagggcagagtcacgattaccgcggacgaatccacgagcacagtctatatggaattgaccagcctgacatcagaggacacggccgtctattttgtgcgacagaaagagattccatactcaggcgggcactatggcagcagctg

SEQ ID NO: 460489 - DNA, 508 bp, Homo sapiens; identical to SEQ ID NO: 449566
  misc_feature: HEFZJCU01CHTVR.8.38.D05.1.454.heavy.3.raw

SEQ ID NO: 460490 - DNA, 501 bp, Homo sapiens; identical to SEQ ID NO: 448591
  misc_feature: HEFZJCU01CDHV3.13.87.H10.1.454.heavy.3.raw

SEQ ID NO: 460491 - DNA, 499 bp, Homo sapiens
  misc_feature: HEFZJCU01D0UB8.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctaccaaaaaccaggtggtccttacaatgaccaacatggaccctgtggacacagccacatattactgtgcacagagatacgggcagcacgtggtttggggctacgtggggccagggaaccctggtcaccgtctcctcagcctccaaccg

SEQ ID NO: 460492 - DNA, 526 bp, Homo sapiens
  misc_feature: HEFZJCU01DY8DW.16.9.A09.1.454.heavy.3.raw
tgtactactccacgaccggtgctcgatttagcgagacgcgcagggggagagaggggcccagccctgggattttcaggtgttttcatttggtgatcaggactgaacagagagaactcaccatggagtttgggctgagctggctttttcttgtggctattttaaaaggtgtccagtgtgaggtgcagttggtggactctgggggagacctgataccgcctggggggtccctgagactctcctgtacagcctctggattcacctttaggagccatgccatgagctgggtccgccaggctccagggaaggggctggagtgggtctctactattactgctagtggtaatcatgcatactatgcagactccgtgaagggccggttcaccttcaccagagacaattccaagaacacgctctatctgcaattgaccagcctgagcgccgaggacacggccatgtattactgtactaaatcgcgggtggccgcggccggtacctcggatggtttgatttctggggcctaagggac

SEQ ID NO: 460493 - DNA, 477 bp, Homo sapiens; identical to SEQ ID NO: 444659
  misc_feature: HEFZJCU01BXLD9.16.10.A10.1.454.heavy.3.raw

SEQ ID NO: 460494 - DNA, 517 bp, Homo sapiens; identical to SEQ ID NO: 446891
  misc_feature: HEFZJCU01CAKCI.17.33.C11.1.454.heavy.3.raw

SEQ ID NO: 460495 - DNA, 514 bp, Homo sapiens
  misc_feature: HEFZJCU01CG4RK.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagcgtggtttcgtgtaggtatttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgagacacggccgtctattattgtgtcatagacctaggatacaacgacggtggtacctggtattc

SEQ ID NO: 460496 - DNA, 486 bp, Homo sapiens; identical to SEQ ID NO: 452184
  misc_feature: HEFZJCU01AP4ON.49.4.A04.1.454.heavy.3.raw

SEQ ID NO: 460497 - DNA, 400 bp, Homo sapiens
  misc_feature: HEFZJCU01B9UUT.47.24.C02.1.454.heavy.3.raw
agctcacgtacacgaccggtgctcgatttagtacagatcgttagggaaagggactggagtggattggctatgttcattccagtgtgagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 460498 - DNA, 471 bp, Homo sapiens; identical to SEQ ID NO: 446080
  misc_feature: HEFZJCU01BABIM.4.36.D03.1.454.heavy.3.raw

SEQ ID NO: 460499 - DNA, 486 bp, Homo sapiens
  misc_feature: HEFZJCU01BRE3J.17.36.D03.1.454.heavy.3.raw
cgtagactagcacgaccggtgctcgatttagctgcgtcacgatctctcttgggtctcagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtaccgcctggggggtccctgagactctcctgtagagcctctggattcgccttcagtacctacagcatgaactgggtccgccaggttccagggaagggtctggagtgggttgcatacattagtagtagtgatagttccatatactacgcagactctgtgaagggccgattcaccatctccagagacagtgccaagaactcactgtatctgcaaatgaacagccttagagacgacgacacggctgtgtattactgtgcgagagatccg

SEQ ID NO: 460500 - DNA, 518 bp, Homo sapiens
  misc_feature: HEFZJCU01EZE3Z.19.13.B02.1.454.heavy.3.raw
tactctcgtgcacgaccggtgctcgatttagtctagcgactttgggttttcctcgttgctcttttaagaggtgtccagtgtcaggtgcacctggtggagtctgggggaggcgtggtccagcctgggaggtccctgagactctcctgtgcagcctctggattcaccttcagtagcttttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacggtctggggccaagggaccacggtcatcgtctccccacgcctccaccaagggcccatcggtcttccccctcggccgccctgctccaggagcacctccgacgagcacacg

SEQ ID NO: 460501 - DNA, 502 bp, Homo sapiens
  misc_feature: HEFZJCU01B1SBG.13.33.C11.1.454.heavy.3.raw
tcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgttgcaataagaattgcaaacgatgcttttgatatgtggggaccgg

SEQ ID NO: 460502 - DNA, 491 bp, Homo sapiens; identical to SEQ ID NO: 447127
  misc_feature: HEFZJCU01DJYQN.12.75.G09.1.454.heavy.3.raw

SEQ ID NO: 460503 - DNA, 402 bp, Homo sapiens
  misc_feature: HEFZJCU01BM3X7.3.72.G06.1.454.heavy.3.raw
agacgcactccacgaccggtgctcgatttagctacgactgcaagggaaaggggctggagtgggtctcagctattagtggtagtggtggtagcacatactacgtagactccgtgaagggccggttcaccatctccagagacaattccaagaacacgctgtatctgcaaatgaacagcctgagagccgaggacacggccgtatattactgtgcgagaggcaggctgtggggcatagtgggtactacctatgcttttgatatctggggccaagggacaatggtcaccgtctcttcagcctccaccaagggcccatcggtcttccccctggcaccctcctccaagagcacctctggggcacagcggccctgggctgcctggtcaaggactacttccgagtgcgtct

SEQ ID NO: 460504 - DNA, 518 bp, Homo sapiens; identical to SEQ ID NO: 449255
  misc_feature: HEFZJCU01B1O1M.3.17.B06.1.454.heavy.3.raw

SEQ ID NO: 460505 - DNA, 505 bp, Homo sapiens
  misc_feature: HEFZJCU01DLCKO.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacgggtcatcgtctcctcagcctccaccaaggcccatcggtcttcccctggcaccctcctccaagagcacctctgggggcacagcggccctgggctgcctggtcaaggactacttcctacgtcgtat

SEQ ID NO: 460506 - DNA, 519 bp, Homo sapiens
  misc_feature: HEFZJCU01AOB3L.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttattatagtagtggtagtacatactccgcagactccgtgaggggccattcaccatctccagagacaattccaagaacacgctgtttcttcaaatgaacagcctgagagccgatgacacggccgtgtattactgtgcgagagatggggcccacgaacgttactacgctatggacgtcgtggggccgaagggaccg

SEQ ID NO: 460507 - DNA, 521 bp, Homo sapiens
  misc_feature: HEFZJCU01CND5F.21.45.E01.1.454.heavy.3.raw
tcgtcgctcgcacgaccggtgctcgatttagtgagtcagtaagggaaagggggctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccaccgtcacagatggttccttctggggctgggtccggcagtccccagagaagggtctggagtggattgggagtgtctataatacggggagtcaatatcgtggtgacactccctactacaacccgtcttttaagagtcgagtcactatatcagtgcgctcgtccacgaaccaggtctccctgaggatgagatctgtgacggccgcagacacggccaagtatttctgtgcgagagaccccggagttagcgacgcctggaggcactggtacttcgatgcctggggccgtggcgccctggt

SEQ ID NO: 460508 - DNA, 510 bp, Homo sapiens
  misc_feature: HEFZJCU01D9Y9K.48.67.G01.1.454.heavy.3.raw
agtatacatacacgaccggtgctcgatttagagtatacatattgggtttgggcacgaccggtgctcgatttagatcgtctgtgttgggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctgcgccctgctccagagcacctccgagagcacagcggccctgggcc

SEQ ID NO: 460509 - DNA, 512 bp, Homo sapiens; identical to SEQ ID NO: 445279
  misc_feature: HEFZJCU01EZQ83.17.33.C11.1.454.heavy.3.raw

SEQ ID NO: 460510 - DNA, 520 bp, Homo sapiens
  misc_feature: HEFZJCU01C76L7.13.21.B10.1.454.heavy.3.raw
tcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagcctggggggtccctgagactctcctgtcaagcctctgggttcagcttcagtgtatattggatgagctgggtccgccagactccagggaaggggctggagtgggtggccaacataaacacagacggaagtgacccatactatgcggactctgtgaagggccgattcaccatctccagagacaacgccaagaactcactatatttgcaaatggaccgcctgagagaacgaggacacgggctaatgtattactgtgcgagagatgagagtggctacaggttgggggccgggggaacctgggtcaccgtcaa

SEQ ID NO: 460511 - DNA, 500 bp, Homo sapiens; identical to SEQ ID NO: 459512
  misc_feature: HEFZJCU01BS8ZR.13.33.C11.1.454.heavy.3.raw

SEQ ID NO: 460512 - DNA, 522 bp, Homo sapiens
  misc_feature: HEFZJCU01CR1HI.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctcccacgcctccaccaaggcccatcggtcttccccctggccg

SEQ ID NO: 460513 - DNA, 506 bp, Homo sapiens; identical to SEQ ID NO: 446520
  misc_feature: HEFZJCU01D8PST.10.38.D05.1.454.heavy.3.raw

SEQ ID NO: 460514 - DNA, 499 bp, Homo sapiens
  misc_feature: HEFZJCU01C5267.51.87.H10.1.454.heavy.3.raw
cgatcgtatacacgaccggtgctcgatttagcagtactgcgttgggtttggggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggctcttttttactgtgcgccaggaagcagtggctggccacatcatgcttttgatatctggagccaagggacaatggtcatcgtctcttcggcctccaccaagggcccatcggtcttcccctggcaccctcctccaagagcacctctggggcacagcggccctgggctgcctggcaggactacttcctcg

SEQ ID NO: 460515 - DNA, 525 bp, Homo sapiens
  misc_feature: HEFZJCU01CR0LJ.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggatacagtggcagctccaagtactactttgacttctggggccagggaaccctggtcaccgtctcctcagcctccaccaagggcccatcggtcttcccctggcgccctgctccaggagcacctccgagacg

SEQ ID NO: 460516 - DNA, 524 bp, Homo sapiens
  misc_feature: HEFZJCU01BHMIC.47.64.F09.1.454.heavy.3.raw
agctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcaccagttttaattattggtggggctggatccgccagcccccagggaaggggctggaatggattgggagtatattttataatggggacactctttacaacccatccctcaagagtcgagtttccatatccgcagacacgtccgagaatcacttctccctgaaactgagctctgtgaccgccgcagacacggctgtttattactgttcgagacatgccgaccgagagcattatcggcagtacggttttgattatttgggggccaaggggacaaggggtcaccgtctccgcagcctccaccg

SEQ ID NO: 460517 - DNA, 520 bp, Homo sapiens
  misc_feature: HEFZJCU01EKXD8.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgcggcctataccacctcagtcagctggttcgacccctggggccagggaaccctggtcaccgtctcctcagcctccaccaagggcccatcggtcttccccctggcaccctcctccaagagcacctctgggggcacagcggccctgggctgcctggtcaaggactacttccgagtagtacac

SEQ ID NO: 460518 - DNA, 499 bp, Homo sapiens; identical to SEQ ID NO: 447792
  misc_feature: HEFZJCU01DBQ0Y.17.10.A10.1.454.heavy.3.raw

SEQ ID NO: 460519 - DNA, 538 bp, Homo sapiens
  misc_feature: HEFZJCU01AZHFW.48.14.B03.1.454.heavy.3.raw
agtatacatacacgaccggtgctcgatttagtgtgagtagttccgcggggaggtctcagagaggagccttagccctggactccaaggcctttccacttggtgatcagcactgagcacagaggactcaccatggaattggggctgatctgggttttccttgttgctctttttggaggtgtccactgtgaggtgcaactggtggaatctgggggaggcttggtccagcctgggggctctctcagactctcctgtgaaacctctggattcacctttacgactttttggatgggttgggtccgccaggccccagggaaggggctgcagtgggtggccaacacaaatcaaaatggaaacgtggagtactatgcggagtctgtgaagggccggttcaccatctacagagacaacggcaagaagtcgctgtttctgcaaatgaacagcctgacctccgacgacacggctctctattattgtgtgagagaatcctggggacccggccgtcttcgggggccagggaacactggttatcgtctcttcg

SEQ ID NO: 460520 - DNA, 522 bp, Homo sapiens
  misc_feature: HEFZJCU01CSSUE.11.25.C03.1.454.heavy.3.raw
cgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatgacgtctggggcaagggaccac

SEQ ID NO: 460521 - DNA, 475 bp, Homo sapiens; identical to SEQ ID NO: 445138
  misc_feature: HEFZJCU01C4EP1.3.39.D06.1.454.heavy.3.raw

SEQ ID NO: 460522 - DNA, 515 bp, Homo sapiens
  misc_feature: HEFZJCU01CC3Z0.48.34.D01.1.454.heavy.3.raw
agtatacatacacgaccggtgctcgatttagatcgtctgtgttgggtttggggggaagaggaagactgacggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactacttcctatgta

SEQ ID NO: 460523 - DNA, 517 bp, Homo sapiens
  misc_feature: HEFZJCU01D23GD.40.9.A09.1.454.heavy.3.raw
tctagcgactcacgaccggtgctcgatttagcgagacgcgcagggacagaggactcaccatggaattggggctgagctgggttttccttgttgctattttagaaggtgtccagtgtgcggtgaaactagcggagtctgggggaggcttggtccagcctggggggtccctaagactctcctgcgcagcctctggattcatgtttagtgattattggatggcttgggtccgtcaggctccagggaaagggctggagtttgtggccaagatgaaccacgacggaaatgagaaaactatgcggactctgtgaagggccgattcaccatttccagagacaacgccaagaagtcactctctctacacatgaccagcctgacagccgaggacacggctgtttattactgtgcgagagatggcactcggggcggtgactttgactactggggccagggcaccctggtcaccgtctcctcagcctccaccaaggcccatcgtcttcccctgcgccctgcaggagca

SEQ ID NO: 460524 - DNA, 503 bp, Homo sapiens
  misc_feature: HEFZJCU01CQGA3.48.28.C06.1.454.heavy.3.raw
agtatacatacacgaccggtgctcgatttagagctcacgtattgggtttggggagctctcagagaggtgccttagccctggattccaaggcatttccacctggtgatcagcactgaacacagaggactcaccatggaggtggggctgtgctgggtgttccttgttgctattttagaaggtgtccaatgtgaggtgcagctggtggaatctgggggtgccttggtgccgccgggggggtccctgagactctcctgtgtagcctccggattcacatttagttcccatagtatggtctgggtccgccaggctccagggaagggtctagagtggatttcatacattaggagtggcagtagtcccatatactacgcagactctgtgaagggccgattcatcatctccagagacaatgccgagaactcactgtttctgcaaatgaacagcctgagagacgaggacacggctgtttattactgtgcgagagtgcggatttcacctacacg

SEQ ID NO: 460525 - DNA, 516 bp, Homo sapiens; identical to SEQ ID NO: 445437
  misc_feature: HEFZJCU01C7OA6.26.71.G05.1.454.heavy.3.raw

SEQ ID NO: 460526 - DNA, 519 bp, Homo sapiens; identical to SEQ ID NO: 444867
  misc_feature: HEFZJCU01CUS4X.9.34.D01.1.454.heavy.3.raw

SEQ ID NO: 460527 - DNA, 506 bp, Homo sapiens; identical to SEQ ID NO: 445425
  misc_feature: HEFZJCU01BLWD0.10.38.D05.1.454.heavy.3.raw

SEQ ID NO: 460528 - DNA, 409 bp, Homo sapiens; identical to SEQ ID NO: 444519
  misc_feature: HEFZJCU01D8UIP.3.41.D08.1.454.heavy.3.raw

SEQ ID NO: 460529 - DNA, 481 bp, Homo sapiens
  misc_feature: HEFZJCU01C47H8.22.86.H09.1.454.heavy.3.raw
  modified_base (437)..(437): a, c, t, g, unknown or other
  modified_base (458)..(458): a, c, t, g, unknown or other
acatacgcgtcacgaccggtgctcgatttagtgctatagacttgagctctgggagaggagcccagcactagaagtcggcggtgtttccattcggtgatcagcactgaacacagaggactcaccatggagtttgggctgagcgtggtttccgtcgttaggctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaagggctggagtgggtggcaattatatggtatgatggaagtaataaagactatgtggactccgtgaagggccgattcaccatctccagagacaatccaagaacactctgttctccaaatgaacagcctnaggaggcgaggacatggcagngtattactgtgcgagagatcgac

SEQ ID NO: 460530 - DNA, 512 bp, Homo sapiens; identical to SEQ ID NO: 450914
  misc_feature: HEFZJCU01CGO3C.15.67.G01.1.454.heavy.3.raw

SEQ ID NO: 460531 - DNA, 546 bp, Homo sapiens
  misc_feature: HEFZJCU01EIIWN.13.65.F10.1.454.heavy.3.raw
tcacgtactacacgaccggtgctcgatttagctacgctctaagggggggagaggagcccagcactgggattccgaggtatttccattcggtgattagcactgaacacagaggactcaccatggagttttggctgagctgggttttccttattactattttaaaaggtgtccagtgtgaggtgcagttggtggagtctggaggaggcttggtccagccgggggggtccctgagactctcatgtgcggcctctgggctcaccgtcaacaccaactacatgagctgggtccgccaggctccagggaagaggccggagtgggtctcagttatttatgtcgacggtgccacattctacgcagactccgtgaggggccggttcaccatctccagagacaattccaagaacacggtgtatcttcaaatgaacgacctgagagtcgaggacacggccgtctattactgtgcgaaagatgcagagacgggccccgtaatggggcctggtgggagggttcttctttgactgcgtggggccaggggaaccctggtcc

SEQ ID NO: 460532 - DNA, 500 bp, Homo sapiens; identical to SEQ ID NO: 445720
  misc_feature: HEFZJCU01AXELB.3.20.B09.1.454.heavy.3.raw

SEQ ID NO: 460533 - DNA, 506 bp, Homo sapiens; identical to SEQ ID NO: 444696
  misc_feature: HEFZJCU01BXS6N.16.34.D01.1.454.heavy.3.raw

SEQ ID NO: 460534 - DNA, 527 bp, Homo sapiens
  misc_feature: HEFZJCU01C871A.48.34.D01.1.454.heavy.3.raw
agtatacatacacgaccggtgctcgatttagatcgtctgtgttgggtttgggggctttctgagagtcatggatctcatgtgcaagaaagtgaagcacctgtggttcttcctcctgctggtggcggctcccagatgggtcctgtccctgatgcaggtgcgggagtctggcccaggattggtgaaaccttcggggaccctgtccctcaactgctttgtctctggaacttctatcaagggtagcagcttctactggggctggatccgccagcccccaggaaaggggctacaatgggttggaatgtcaattcttatgggcgctcccactacaatccggccctccagagtcgagccctcatatccatagacacgtccaacaaccagttttccctgacgctgacgtctgtgaccgccgcagacacggctgtctattattgtgcgagactaggcttctgtagtggtggtacttgcaacccgggatactactccaacttcggcttggacatctggggccaagggacctcggtccg

SEQ ID NO: 460535 - DNA, 525 bp, Homo sapiens; identical to SEQ ID NO: 450208
  misc_feature: HEFZJCU01A35K5.3.82.H05.1.454.heavy.3.raw

SEQ ID NO: 460536 - DNA, 540 bp, Homo sapiens
  misc_feature: HEFZJCU01CEIK5.48.40.D07.1.454.heavy.3.raw
agtatacatacacgaccggtgctcgatttagtgatagagcgtaacaacagagggggagccccagacctgggattcccagctgtttctgcttgctgatcaggaccgcacacagagagctcaccatggagttggggctgacctgggttttccttgtggctactttaagaggtgtcctgtgtgaggtgcacctgctggagtccgggggaggcttagttcggccggggagtccctgagactcgcctgtgtagtgtctggattcaccttcaggaattacgacatggactgggtccgccaagctccagggaaggggctggagtgggtctcaaacgtgaacgttgatggcgggatcacaaaatacgcggactccgtgaaaggccgcttcaccgtctccagagacaacggcgagaatactctgtatttgcagatgagaaatctgagaggcgaggaccaccgcgctttattattgtacaacgtcgttttacttttctaatggtggcttcttacgaacgacatgactattggggtcgggaaccctggtcc

SEQ ID NO: 460537 - DNA, 508 bp, Homo sapiens
  misc_feature: HEFZJCU01DGAKD.52.78.H01.1.454.heavy.3.raw
cgcagtacgacacgaccggtgctcgatttagtgtgagtagtttgggtttggggggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctaccaaatgagcagcctgacatccgaggacacggccgtgtattactgtgcgagagttcttgggatgttgtcgttgcacc

SEQ ID NO: 460538 - DNA, 513 bp, Homo sapiens
  misc_feature: HEFZJCU01ECWSV.13.33.C11.1.454.heavy.3.raw
tcacgtactacacgaccggtgctcgatttagagtgagctcgtttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacgacgggccgttttattattgtgcaaataagaattgcaaacgatgtcttttagatatggtggggccgaagggactacg

SEQ ID NO: 460539 - DNA, 523 bp, Homo sapiens
  misc_feature: HEFZJCU01EM9NW.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttgggccagggaaccctggtcaccgtctcctcagcctccaccaagggcccatcggtcttcccctggcgccctgctccaggagcacctccgagagcacagcggccctgggctgcctggtcaaggactacttcc

SEQ ID NO: 460540 - DNA, 396 bp, Homo sapiens; identical to SEQ ID NO: 444731
  misc_feature: HEFZJCU01BO2M2.18.61.F06.1.454.heavy.3.raw

SEQ ID NO: 460541 - DNA, 497 bp, Homo sapiens
  misc_feature: HEFZJCU01B7XGY.40.81.H04.1.454.heavy.3.raw
  modified_base (494)..(494): a, c, t, g, unknown or other
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtgacacaaagtatcgacagaactttcagggcagggtcaccatgacctgggacgcgtccatcagcacagtctacatggatctgagcggactgacctcgtgacgacaccggccatgtattactgtggaagagacgttggtggctaccggcggggctgaccncgt

SEQ ID NO: 460542 - DNA, 533 bp, Homo sapiens
  misc_feature: HEFZJCU01AQDUA.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagtttgggctgagctggattttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaggcaggttcaccgtctccagaaatgattcaaagaacacggcgtatctgcaaatgaacagcctgaaaccgaggacacggccgtgtattactgtactagacaggtggattacagtttgggggagttaatcgcgaacgggggggttaacg

SEQ ID NO: 460543 - DNA, 522 bp, Homo sapiens; identical to SEQ ID NO: 445345
  misc_feature: HEFZJCU01AJICJ.19.86.H09.1.454.heavy.3.raw

SEQ ID NO: 460544 - DNA, 521 bp, Homo sapiens
  misc_feature: HEFZJCU01B9KQ3.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaaggcccatcggtcttccccctggcg

SEQ ID NO: 460545 - DNA, 511 bp, Homo sapiens; identical to SEQ ID NO: 445840
  misc_feature: HEFZJCU01DFC7F.11.13.B02.1.454.heavy.3.raw

SEQ ID NO: 460546 - DNA, 482 bp, Homo sapiens
  misc_feature: HEFZJCU01CAT4Z.47.59.F04.1.454.heavy.3.raw
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggcccatcggtcttccccctggcgccctgctccaggagcacctccgagagcacagcggcctgggctgcctggtcaaggactacttcctacgtgagct

SEQ ID NO: 460547 - DNA, 510 bp, Homo sapiens; identical to SEQ ID NO: 455775
  misc_feature: HEFZJCU01BQQCP.4.33.C11.1.454.heavy.3.raw

SEQ ID NO: 460548 - DNA, 502 bp, Homo sapiens
  misc_feature: HEFZJCU01EH191.48.44.D11.1.454.heavy.3.raw
agtatacatacacgaccggtgctcgatttagcgcagtacgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttgccgtataggacaaacctaataatacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggactacttcctatgtatact

SEQ ID NO: 460549 - DNA, 396 bp, Homo sapiens; identical to SEQ ID NO: 444469
  misc_feature: HEFZJCU01A301M.47.46.E02.1.454.heavy.3.raw

SEQ ID NO: 460550 - DNA, 513 bp, Homo sapiens
  misc_feature: HEFZJCU01A4RAY.9.78.H01.1.454.heavy.3.raw
tgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaacgggcccactcggtccttccccctcggccgccctcgctccaggagcacctccgagagcacagcggccctgggctgcctgtcaaggactattccagacgtatca

SEQ ID NO: 460551 - DNA, 528 bp, Homo sapiens; identical to SEQ ID NO: 448261
  misc_feature: HEFZJCU01DQKXD.18.33.C11.1.454.heavy.3.raw

SEQ ID NO: 460552 - DNA, 523 bp, Homo sapiens
  misc_feature: HEFZJCU01CJK68.47.78.H01.1.454.heavy.3.raw
agctcacgtacacgaccggtgctcgatttagtgtgagtagtttgggtttggggctctctgagagtcagggacctcctgcattagcacatgaaacacctgtggttcttccgcctcctggtgacagctcccagatttgactgcctcaggaatgccgatttgaagatgtgagatgctgcctctgatcccaggactcactgcgggtttctctgttcacaggggtcctgtcccaggtgcaaccacaccactggggcgcaggactgttgaagccttcggagaccctgtccctcacctgcgctgtctgtggtgggtccttcagtgactactactgagactagatccgccagtccccagggaagggctggaatggattcgacaggtcaatcattacagatccaccaactacaacccgtccctcagcagtcgagtcaccttttcgcttgacacgtccaacaaccagttttctctgaatcaaaacccgagaccgccgcggacagcctcggcccctggggccccagtaaacccg

SEQ ID NO: 460553 - DNA, 501 bp, Homo sapiens
  misc_feature: HEFZJCU01ENKS5.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaacaactggtcaccgtctcctcagcctccaccaagggcccatcggtcttcccctggccgccctgctccaggagcacctccgagagcacagcggccctgggctgcctggtcaaggactactccga

SEQ ID NO: 460554 - DNA, 507 bp, Homo sapiens
  misc_feature: HEFZJCU01CH7BM.52.78.H01.1.454.heavy.3.raw
cgcagtacgacacgaccggtgctcgatttagtgtgagtagtttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttccccctggcaccctcctccaagagcacctctgggggcacagcggccctgggctgcctggtcaaggactacttcctatacgatcg

SEQ ID NO: 460555 - DNA, 507 bp, Homo sapiens
  misc_feature: HEFZJCU01ETN8R.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgtgtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtaacgaaaggaggggggatacgagtggcagctccaagtaa

SEQ ID NO: 460556 - DNA, 494 bp, Homo sapiens
  misc_feature: HEFZJCU01EXAA2.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgacttc

SEQ ID NO: 460557 - DNA, 514 bp, Homo sapiens
  misc_feature: HEFZJCU01ALC67.48.26.C04.1.454.heavy.3.raw
agtatacatacacgaccggtgctcgatttagtctagcgactttgggtttggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagaagggttttactagtggttcggggagtctccgacccagcaactggttcgtacccc

SEQ ID NO: 460558 - DNA, 493 bp, Homo sapiens
  misc_feature: HEFZJCU01EAXBC.19.53.E09.1.454.heavy.3.raw
tactctcgtgcacgaccggtgctcgatttagagagagtgtgttgggtttggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagcggcccgtgggcctgcctggtcaaggactacttcccacgacgagta

SEQ ID NO: 460559 - DNA, 518 bp, Homo sapiens
  misc_feature: HEFZJCU01EK7L1.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcacccagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctccaccaaggcccatcggt

SEQ ID NO: 460560 - DNA, 450 bp, Homo sapiens; identical to SEQ ID NO: 447544
  misc_feature: HEFZJCU01EG1ZX.10.38.D05.1.454.heavy.3.raw

SEQ ID NO: 460561 - DNA, 518 bp, Homo sapiens
  misc_feature: HEFZJCU01EKMNF.22.73.G07.1.454.heavy.3.raw
acatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagttactactggagctggctccggcagtccccagggaagggactggagtggattgggtatatctattacactgggagcaccgactacagcccctccctcatgagtcgagtcaccatttcactagacacgtccaagaaccagttctccctgaaactgaggtctgtgaccgctgcggacacggccgtctattactgtgcgagatttgctttttggagttggttacgccgcgtttgactactggggtccagggaaccctggtcaccgtctcctcagcctccaccaac

SEQ ID NO: 460562 - DNA, 516 bp, Homo sapiens
  misc_feature: HEFZJCU01AW2BX.26.57.F02.1.454.heavy.3.raw
agactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaagggctggagtggcttggccgtattagaaccaaacctgacaagtacgcgacaatttatgctgcgtcggtgcaaggcaggttcaccatctccagagatgattcagagaacacggcgtatctgcaaatgaacagcctgaaaaccgaggacacggccgtgtattactgtgccagacatccgtcgtattacgatttttctagtggt

SEQ ID NO: 460563 - DNA, 501 bp, Homo sapiens; identical to SEQ ID NO: 448591
  misc_feature: HEFZJCU01DNJ82.13.87.H10.1.454.heavy.3.raw

SEQ ID NO: 460564 - DNA, 518 bp, Homo sapiens
  misc_feature: HEFZJCU01D87F9.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaagagtcgggcccaggactagtgaagccttcacaggccctgtccctcacctgcactgtctctggtgactcaatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctagttaaaactcctactacggtctggacgtctgggccaggggaccaac

SEQ ID NO: 460565 - DNA, 514 bp, Homo sapiens
  misc_feature: HEFZJCU01ED8E1.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgacgcagacacggccgtgtattactgtgcgagactggccgcaacagactacggtggcaactcctatgcttttgatatctgggccaagggacaatggtcaccgtctcttcagcctccaccaagggcccatcggtcttcccctggccaccctcctccaagagcacctctggggcacagcggcccg

SEQ ID NO: 460566 - DNA, 477 bp, Homo sapiens; identical to SEQ ID NO: 444659
  misc_feature: HEFZJCU01AU4H1.16.10.A10.1.454.heavy.3.raw

SEQ ID NO: 460567 - DNA, 520 bp, Homo sapiens
  misc_feature: HEFZJCU01CPJ06.10.59.F04.1.454.heavy.3.raw
catagtagtgcacgaccggtgctcgatttagtacacacacttagggattgggggctttctgagagtcatggacctcctgtgcaagaacatgaatcacctgtggttcttcctcctgctggtggcggcccccagatgggtcctgtcccagctgcagctgcatgagtcgggcccaggactggtgaggccttcggataccctgtccctcagttgcgctgtctctggtggctccatcaacagtggtgacaactggtggggctgggtccgccagcccccagggatgggactggagtggattggccttacacattatagtgggactacccactacaacccgtccctcaggagtcgagtcaccatctcactagacacgtccaggaatcacctctccctgacggtgacctctgtgaccgccgcggacacggccgtgtattattgtgcgagagaccccgctgaagattcctcaaatgtactttgaccactgggggccaggggacgccctgggtcacccggtctcctcacg

SEQ ID NO: 460568 - DNA, 529 bp, Homo sapiens
  misc_feature: HEFZJCU01AMC49.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcgtttgtcttctccatggatacctctgtcgggacggcttatctgcagataaccaaccttcaacctgacgacactgccgtttattttgtacgagagcgtcgtctgtcagtggaattgactactgggccagggaaccctggtcaccgtctcctcagcctccaccaaggg

SEQ ID NO: 460569 - DNA, 518 bp, Homo sapiens; identical to SEQ ID NO: 449255
  misc_feature: HEFZJCU01DNSPJ.3.17.B06.1.454.heavy.3.raw

SEQ ID NO: 460570 - DNA, 493 bp, Homo sapiens
  misc_feature: HEFZJCU01CU4LC.51.27.C05.1.454.heavy.3.raw
cgatcgtatacacgaccggtgctcgatttagacgcgatcgaagggtttggggtctgggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtacaccctctggattcaccttcagtaactatgcaatgcactgggtccgccaggctccaggcaaggggctggactgggtggcaggtatatcatatgatggaagcaataaatactacgcagactccgtgaagggccgattcaccatctccagagacagttccgatgacacagtctatctgcaaatgaacagcctgagagctgaggacacggcttctttttactgttgcgccaggaagcaggtggc

SEQ ID NO: 460571 - DNA, 519 bp, Homo sapiens
  misc_feature: HEFZJCU01AL13V.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggccaccctcctccaagagcacctctgggggcacagcggccctgggctgcctggtcaaggactacttccagacgtatca

SEQ ID NO: 460572 - DNA, 406 bp, Homo sapiens
  misc_feature: HEFZJCU01DIZ6F.11.67.G01.1.454.heavy.3.raw
cgagagataccacgaccggtgctcgatttagagtatacatattgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtccagatattgcactggtggcaactgctacgacgcctactattatcaccacatggacgtctggggcaaagggaccacggtcatcgtctcctcagcctccaccaagggcccatcggtcttccccctggcaccctcctccaagagcacctctgggggcacagcggccctgggctgcctggtcaaggactcttccgtatctctcg

SEQ ID NO: 460573 - DNA, 437 bp, Homo sapiens
  misc_feature: HEFZJCU01BM4RH.51.11.A11.1.454.heavy.3.raw
cgatcgtatacacgaccggtgctcgatttagctacgactgcagggtctatgacatgcactgggtccgccaggctccaggcaaggggctggagtgggtggcagttatatcatatgatggaagtaataaatactatgcagactccgtgaagggccgattcaccgtctccagagacaattccaagaatacgctgtatctgcacatgaacagcctgagagctgaagacacgggtgtttattactgtgcgaacttaattacggaggacaacggtaaccccgtccgcacggtacggacgtctggggccaagggaccacggtcaccgtctcctcagcctccaccaagggcccatcggtcttcccctggcaccctcctccaagagcacctctgggggcacagcggccctgggctgcctggtcaaggactacttcctcgtagcact

SEQ ID NO: 460574 - DNA, 510 bp, Homo sapiens
  misc_feature: HEFZJCU01EM07D.48.35.D02.1.454.heavy.3.raw
agtatacatacacgaccggtgctcgatttagcacacgatagttgggtttgggggagccttggtgcagcctggagagtccctaagactctcctgcgcagcctcaggattcagtttcagtagttatgaaatgaattgggtccgccaggctccagggaagggactggagtggctttcatatattactggcagtgggtctcttacccattatgcagactctgtagaggggccgattcaccatctccagagacaacccccgaaactctctttttctgcaaatggacagcctgacagccgacgatacggccatttattactgtgcgagagatgggacccccgcatatccagaaggcacactctactttgacctctggggccaggggatcctggtcaccgtctcctcagcctccaccaagggcccatcggtcttcccctggcgccctgctccaggagcacctccgagagcacagcggccctgggctgcctggtcaaggactacttcctatgtatact

SEQ ID NO: 460575 - DNA, 462 bp, Homo sapiens
  misc_feature: HEFZJCU01DG0R7.4.6.A06.1.454.heavy.3.raw
agcactgtagcacgaccggtgctcgatttagatctactgacagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcaccaccgcctacctgcagtggagcagcctgaaggcctcggacaccgccatgtattactgtgcgagcgcctatagatatagcagcacctggtacatgtggcgtggtgcttttgatatctggggccaagggacaatggtcaccgtctcttcagcctccaccaagggcccatcggtcttcccctggccaccctcctccaagagcacctctgggggcacagcggccctgggctgcctggtcaaggactacttccctacagtgct

SEQ ID NO: 460576 - DNA, 520 bp, Homo sapiens; identical to SEQ ID NO: 447178
  misc_feature: HEFZJCU01CDQ1D.47.64.F09.1.454.heavy.3.raw

SEQ ID NO: 460577 - DNA, 527 bp, Homo sapiens
  misc_feature: HEFZJCU01CJLHY.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttcgtggggccagggggaccctggtcatcgtctccccagcctccaccaacgggcccatcggtccttccccctggccg

SEQ ID NO: 460578 - DNA, 485 bp, Homo sapiens
  misc_feature: HEFZJCU01DEMAZ.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctcggcaccctcctcccaagagcacctctgggggcacagcggccctgggctgcctggtcaaggactacttcctagagacacg

SEQ ID NO: 460579 - DNA, 528 bp, Homo sapiens
  misc_feature: HEFZJCU01BK218.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtcccgtgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgagttcaccatctccagagacaattacaagaacaccctttatctgcaaatagacagcctgagaccagacgacacggctgtctattattgcgcgagagaggacacacgaacctactggccaatactatgggggcttgttctggggccaggggaccctggtcatcgtctccccagcctccaccaagggcccatcggtcttcccctgcgcctcg

SEQ ID NO: 460580 - DNA, 497 bp, Homo sapiens
  misc_feature: HEFZJCU01B5237.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttatactggtgggagaaatcctagtggcac

SEQ ID NO: 460581 - DNA, 513 bp, Homo sapiens
  misc_feature: HEFZJCU01B3QIN.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacgggtcatcgtctccgcagcctccaccaagggcccatcggtcttcccctggcaccctcctccaagagcacctctgggggcacagcggccctgggctgcctggtcaaggactacttccgagtgcgtct

SEQ ID NO: 460582 - DNA, 502 bp, Homo sapiens
  misc_feature: HEFZJCU01DNCO3.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgtttctgcaatgaacagcctgagaattgaggactcgggtatatactactgtgccgtgacccctgactgataaaccggactggttcgaccccgtggggccacgggaaccctcggtcaccgtctcctcg

SEQ ID NO: 460583 - DNA, 535 bp, Homo sapiens
  misc_feature: HEFZJCU01ELVDS.18.59.F04.1.454.heavy.3.raw
tacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattacaaaagcacgctgtatctgcaaatgaacagcctgacgaaccgaggacacagccgtgtattactgtaccacatcccctgaaagcgtacaactactactactacggtatggacctcg

SEQ ID NO: 460584 - DNA, 514 bp, Homo sapiens; identical to SEQ ID NO: 451806
  misc_feature: HEFZJCU01BDJC9.19.67.G01.1.454.heavy.3.raw

SEQ ID NO: 460585 - DNA, 512 bp, Homo sapiens
  misc_feature: HEFZJCU01CXDF2.10.71.G05.1.454.heavy.3.raw
catagtagtgcacgaccggtgctcgatttagtgtcgtcgcaagagagaggggggcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatcctagtggcatcacctggtattgtgacttccggggccaggggaaccgtggtcaccggtcttccg

SEQ ID NO: 460586 - DNA, 390 bp, Homo sapiens; identical to SEQ ID NO: 444541
  misc_feature: HEFZJCU01BNQ4B.16.24.C02.1.454.heavy.3.raw

SEQ ID NO: 460587 - DNA, 509 bp, Homo sapiens; identical to SEQ ID NO: 444586
  misc_feature: HEFZJCU01C56B7.12.78.H01.1.454.heavy.3.raw

SEQ ID NO: 460588 - DNA, 527 bp, Homo sapiens
  misc_feature: HEFZJCU01D7Z7K.18.59.F04.1.454.heavy.3.raw
tacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacactccctgaaagcgtcaactactactactacggtatcggacctc

SEQ ID NO: 460589 - DNA, 507 bp, Homo sapiens
  misc_feature: HEFZJCU01BYSWZ.13.67.G01.1.454.heavy.3.raw
tcacgtactacacgaccggtgctcgatttagagtatacatattgggtttggggtctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaaggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgcaaaagatccaaccccttacgactttttaggt

SEQ ID NO: 460590 - DNA, 522 bp, Homo sapiens
  misc_feature: HEFZJCU01CIMJE.52.22.B11.1.454.heavy.3.raw
cgcagtacgacacgaccggtgctcgatttagacgacagctcaggggctgggagaggagcccagccgtgagattcccaggagattccacttggtgatcagcactgaacacagacctccaaccatggagtttgggcttagctgcgttttccttgttgctattttaaaaggtgtccaatgtgaggtgcagctggttgagtctgggggaggcttggtacagccagggcggtccctgagactctcctgtgtaacctcaggattcatgtttggtgattatggaatgacctgggtccgccaggctccaggggagggcctggagtgggtagctttcgttagcagaaagactgaaggtggacaacagaatacgtcgcgtctgtgaaaggcagatttatcatctcaagagacgattccaaaggcatcgcctatctgcaaatgaaacagcctgaaaaccgaggacacagccgtgttatttttgtactagagtcttcttgtattactatgattactagttggttttacaggtac

SEQ ID NO: 460591 - DNA, 510 bp, Homo sapiens
  misc_feature: HEFZJCU01DK0N7.8.34.D01.1.454.heavy.3.raw
ctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctggggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaaggagggggaaccgagcgggagtccaagtactcctttg

SEQ ID NO: 460592 - DNA, 464 bp, Homo sapiens
  misc_feature: HEFZJCU01AH0PZ.48.7.A07.1.454.heavy.3.raw
agtatacatacacgaccggtgctcgatttagcacgtgtcgcaggggcagggtgtacacctgtggttctcggggctgtcctttggttttggagatggttttctcgatgggggctgggatggctcaacgctgacgatggtcaaacaaaatattcacagcaattccagggcagactctcccttaccagggacacttccgcgaacacaggctacatgtttttgagcagactgacatctaaagacacggctatttactactgtgcgagaggcggatttgtcggcgtggtgattgttacagtcagaatcgtcgattgtggttcgacccctgggccagggaaccctgctctccgtctcctcagcttccaccaagggcccatcggtcttcccctggcgccctgctccaggagcacctctgggggcacagcggccctgggctgcctggtcaaggactacttcctatgtatact

SEQ ID NO: 460593 - DNA, 487 bp, Homo sapiens; identical to SEQ ID NO: 445219
  misc_feature: HEFZJCU01B4PXR.10.85.H08.1.454.heavy.3.raw

SEQ ID NO: 460594 - DNA, 433 bp, Homo sapiens
  misc_feature: HEFZJCU01DZ3TZ.40.34.D01.1.454.heavy.3.raw
tctagcgactcacgaccggtgctcgatttagatcgtctgtgttgggtttgggatacaactttaccatctactggatcgcctgggtgcgccagatgcccgggaaaggcctagagtgggtgggaatcgtctatcctgacgactctgataccagatacagcccgtccttccaaggccaggtcaccatctcagccgacaagtccgtcaataccgcctacctgcagtggagcagtctgcaggcctcggacaccgccatgtacttctgtcgcgagagggttcggggatgactactggggccagggaaccctggtcaccgtctcttcttagcttccaccaagggcccatcggtcttccccctggcgccctgctccaggagcacctctgggggcacagcggccctgggctgcctggtcaaggactacttccagtcgctaga

SEQ ID NO: 460595 - DNA, 508 bp, Homo sapiens
  misc_feature: HEFZJCU01AEUTO.11.72.G06.1.454.heavy.3.raw
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaagggcctcaggttacaccttcaccgctaatggtatcacctggcttcgacaggcccctggacaaggacttgagtgggtgggatggatcaactctcacactggaagcagagtctatgcggagagattccagggcagagtcaccctgaccacagagacatccacgaccacagtctacatggagctgtggagcctgagacctgacgacacggccctctattactgtgcgaggccctatcctacagtgaccactccacgctggttcgacctctggggccaac

SEQ ID NO: 460596 - DNA, 379 bp, Homo sapiens
  misc_feature: HEFZJCU01AWHD6.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggagaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 460597 - DNA, 323 bp, Homo sapiens
  misc_feature: HEFZJCU01A8KEN.18.17.B06.1.454.heavy.3.raw
tacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttgggccgcatgaacttccactttgactattggggccagggagccctggtcaccgtctcctcagcctccaccaagggcccatcggtcttccccctggcgccctgctccaggagcacctccgagagcacagcggccctgggctgcctggtcaaggactacttcccatactcgta

SEQ ID NO: 460598 - DNA, 480 bp, Homo sapiens
  misc_feature: HEFZJCU01C7TYU.47.59.F04.1.454.heavy.3.raw
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggcccatcggtcttcccctgcgcctgctccaggagcacctccgagagcacagcggccctgggctgcctggtcaaggactacttcctacgtgagct

SEQ ID NO: 460599 - DNA, 517 bp, Homo sapiens
  misc_feature: HEFZJCU01C85UK.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttcttcaatgaacagcctgagagccgatgacacggccgtgtattactgtgcgagagatggggcccacgaacgttactacgctatggacgtctggggccaagggaccg

SEQ ID NO: 460600 - DNA, 512 bp, Homo sapiens
  misc_feature: HEFZJCU01CQUPS.13.23.C01.1.454.heavy.3.raw
tcacgtactacacgaccggtgctcgatttagtacacgtgattagggattggggctgggagaggagccccagccgtgagattcccaggagtttccacttggtgatcagcactgaacacagaccaccaaccatggagtttgggcttacttgggttttccttgttgctattttaaaaggtgtccaatgtgagctgcagctggtggagtctgggggaggtttggtacagccagggcggtccctgagactctcctgtataacttctggattcaacttgggtgattatgctatgaactgggtccgccaggctccagggaaggggctggagtgggtaggtttcattaggagcaattctcatgatgggacaacagaatacgccgcgtctggtaaaaggcagattcaccatctcaagagatgagtccagaagcatcgcctttctgcagatgagtagcctgaagaccgaggacacagccatctattactgtgctagagagtaattgcagtccctacggacct

SEQ ID NO: 460601 - DNA, 527 bp, Homo sapiens
  misc_feature: HEFZJCU01CUFQX.12.40.D07.1.454.heavy.3.raw
atacgacgtacacgaccggtgctcgatttagtgatagagcgtaacacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacacaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttccccctggccgcctcg

SEQ ID NO: 460602 - DNA, 433 bp, Homo sapiens
  misc_feature: HEFZJCU01B2BC1.11.39.D06.1.454.heavy.3.raw
cgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgagggagtcctattacgcagctggctactacgttgacttctggggccaggggaccctggtcaccgtctcctcagcctccaccaagggcccatcggtcttccccctggcaccctcctccaagagcacctctgggggcacgagcggccctgggctgcctggtcaaggactacttccgtatctctcg

SEQ ID NO: 460603 - DNA, 483 bp, Homo sapiens; identical to SEQ ID NO: 453752
  misc_feature: HEFZJCU01CE8TP.19.53.E09.1.454.heavy.3.raw

SEQ ID NO: 460604 - DNA, 512 bp, Homo sapiens; identical to SEQ ID NO: 448125
  misc_feature: HEFZJCU01BAJ65.19.67.G01.1.454.heavy.3.raw

SEQ ID NO: 460605 - DNA, 506 bp, Homo sapiens
  misc_feature: HEFZJCU01DAVNW.48.45.E01.1.454.heavy.3.raw
agtatacatacacgaccggtgctcgatttagtgagtcagtaaggggaaaggggggggaggcttggtacagcctggcaggtccctgaaactctcctgtgtagcctctggattcaggttgggcgattatgccatgcaatgggtccggcaaggtccagggaagggcctggagtgggtctcaggcatcgattggaaaagcgagaagattgactatgcggagtctgtgaaggggcgattcatcatctccagagacaacgccaagaactccctgtatttgcagatgaacaatctgagacctgacgacacggccttgtattattgtgcaaaagttgtggagtcacagtctctggactacggtatggacgtctggggccaagggaccacggtcacagtctcctcagcctccaccaagggcccatcggtcttcccctggcaccctcctccaagagcacctctgggggcacagcggccctgggctgcctggtcaaggactacttcctatgtatact

SEQ ID NO: 460606 - DNA, 522 bp, Homo sapiens
  misc_feature: HEFZJCU01AT4YC.47.78.H01.1.454.heavy.3.raw
agctcacgtacacgaccggtgctcgatttagtgtgagtagtttgggtttggggctctctgagagtcagggacctcctgcattagcacatgaaacacctgtggttcttccgcctcctggtgacagctcccagatttgactgcctcaggaatgccgatttgaagatgtgagatgctgcctctgatcccaggactcactgcgggtttctctgttcacaggggtcctgtcccaggtgcaaccacaccactggggcgcaggactgttgaagccttcggagaccctgtccctcacctgcgctgtctgtggtgggtccttcagtgactactactgagactagatccgccagtccccagggaaggggctggaatggattcgacaggtcaatcattacagatccaccaactacaacccgtccctcagcagtcgagtcaccttttcgcttgacacgtccaacaaccagttttctctgaatcaaaacccgagaccgccgcggacagcctcggcccctggggcccagaaacccg

SEQ ID NO: 460607 - DNA, 501 bp, Homo sapiens
  misc_feature: HEFZJCU01EFN6R.51.71.G05.1.454.heavy.3.raw
cgatcgtatacacgaccggtgctcgatttagtgtcgtcgcaagagagagggggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagaacaactcgaagaatacggttcttctacaaatgaacagcctgagagctggaggacacggctattgttttactgttgcgagagggaactcgattacagcag

SEQ ID NO: 460608 - DNA, 505 bp, Homo sapiens
  misc_feature: HEFZJCU01CIO0G.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacgggccacctattattgtgcgcgacatgactacgctcaattctggggccagggagcccaggtcaccgtctccccagcctccaccaaggcccatcggtcttccccctggcgccctgctccaggagcacctccgagagcacagcggccctgggctgcctggtcaaggactacttcccactact

SEQ ID NO: 460609 - DNA, 521 bp, Homo sapiens
  misc_feature: HEFZJCU01B5PBI.47.64.F09.1.454.heavy.3.raw
agctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcaccagttttaattattggtgggctggatccgccagcccccagggaaggggctggaatggattgggagtatattttataatggggacactctttacaacccatccctcaagagtcgagtttccatatccgcagacacgtccgagaatcacttctccctgaaactgagctctgtgaccgccgcagacacggctgtttattactgttcgagacatgccgaccgagagcattatcggcaggtacggttttgatattttggggccaagggacaagggtcaccgtctccgcagcctccaccg

SEQ ID NO: 460610 - DNA, 502 bp, Homo sapiens
  misc_feature: HEFZJCU01DEDZN.21.70.G04.1.454.heavy.3.raw
tcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgccctattacggtatggacgtctggggccaagggaccgcagtcaccgtctcctcagcctccaccaagggcccatcggtcttccccctggcgccctgctccaggagcacctccgagagcacagcggccctgggctgcctggtcaaggacacttcccgagcgacga

SEQ ID NO: 460611 - DNA, 502 bp, Homo sapiens; identical to SEQ ID NO: 444768
  misc_feature: HEFZJCU01CR8H3.21.70.G04.1.454.heavy.3.raw

SEQ ID NO: 460612 - DNA, 479 bp, Homo sapiens
  misc_feature: HEFZJCU01EREGV.51.80.H03.1.454.heavy.3.raw
cgatcgtatacacgaccggtgctcgatttagctgtgcgtcgaagggaaagggggcagagcctgctgaattctggctgaccagggcagtcaccagagctccagacaatgtctgtctccttcctcatcttcctgcccgtgctgggcctcccatggggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagttgctgggaaggacatactacaggtccaagtggtttaatgattatgcagtatctgtgaaaagtcgaataaccatcaacccagacacatccaagaaccagttctccctgcaactgaactctgtgactcccgaggacacggccgtgtattactgtgcaagaggttggttaac

SEQ ID NO: 460613 - DNA, 476 bp, Homo sapiens; identical to SEQ ID NO: 444605
  misc_feature: HEFZJCU01CX0YV.12.81.H04.1.454.heavy.3.raw

SEQ ID NO: 460614 - DNA, 512 bp, Homo sapiens
  misc_feature: HEFZJCU01ALYU1.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggtttcctgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatctattgttgtttcgatgtccttcggtccgcgggtacttgtcggggccgagggaccct

SEQ ID NO: 460615 - DNA, 339 bp, Homo sapiens; identical to SEQ ID NO: 450710
  misc_feature: HEFZJCU01DARQP.53.8.A08.1.454.heavy.3.raw

SEQ ID NO: 460616 - DNA, 520 bp, Homo sapiens; identical to SEQ ID NO: 445471
  misc_feature: HEFZJCU01CMI4Q.12.40.D07.1.454.heavy.3.raw

SEQ ID NO: 460617 - DNA, 517 bp, Homo sapiens
  misc_feature: HEFZJCU01AZ666.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctacgatctgacgacgcggccgtatattactgtgcgagagtacgtagcggctcgtcctttgactactggggcctggggaactctggtcaccgtctcct

SEQ ID NO: 460618 - DNA, 519 bp, Homo sapiens
  misc_feature: HEFZJCU01DUR0Q.11.13.B02.1.454.heavy.3.raw
cgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgacgagcacacgcggccctcgggctcg

SEQ ID NO: 460619 - DNA, 493 bp, Homo sapiens
  misc_feature: HEFZJCU01CXAMB.14.25.C03.1.454.heavy.3.raw
  modified_base (398)..(398): a, c, t, g, unknown or other
  modified_base (473)..(473): a, c, t, g, unknown or other
cgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagngacaattccaagaacacgcagtatctgcaaatgaacagcctgagagctgaggacacggctgtgtattctgtgggngagatgggagtcgatattgt

SEQ ID NO: 460620 - DNA, 511 bp, Homo sapiens
  misc_feature: HEFZJCU01DWEKD.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgacgcctacgggcaggccggctttgacttcgtcggggccagggg

SEQ ID NO: 460621 - DNA, 463 bp, Homo sapiens
  misc_feature: HEFZJCU01DB91N.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactgggacggggggaaaattggggccagggaaccctggtctccgtctcgtcagcctccaccaagggcccatcggtcttccccctggcgccctgctccaggagcacctccgagagcacagcggccctgggctgcctggtcaaggctacttcccacgagagta

SEQ ID NO: 460622 - DNA, 499 bp, Homo sapiens
  misc_feature: HEFZJCU01D519H.48.34.D01.1.454.heavy.3.raw
agtatacatacacgaccggtgctcgatttagatcgtctgtgttgggctctgggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaatgagcgcctgagacctgacgacacggctgtctattactgtgcgagagggcgtcgagtttaacacgccgtcgggagg

SEQ ID NO: 460623 - DNA, 505 bp, Homo sapiens
  misc_feature: HEFZJCU01BAEDQ.48.82.H05.1.454.heavy.3.raw
agtatacatacacgaccggtgctcgatttagtcgagctctctcgcgggcacgaccggtgctcgatttagtacacgtgattagggattgggtagggattggggcagggtgtacacctgtggttctcggggctgccctttggctttggagatggttttctcgatgggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggcccccgagcgcagtggctttttgatgcctttgatatgtggggccaagggacaatggtcaccgtctcttcagcctccaccaagggcccatcggtcttcccctggcaccctcctccaagagcacctctgggggcacagcggccctgggctgcctggtcaaggactacttcctatgtatact

SEQ ID NO: 460624 - DNA, 525 bp, Homo sapiens; identical to SEQ ID NO: 451902
  misc_feature: HEFZJCU01BVC5K.16.27.C05.1.454.heavy.3.raw
  modified_base (518)..(518): a, c, t, g, unknown or other

SEQ ID NO: 460625 - DNA, 465 bp, Homo sapiens
  misc_feature: HEFZJCU01DS7VT.9.30.C08.1.454.heavy.3.raw
tgatacgtctcacgaccggtgctcgatttagtctgacgtcaaagggaaagggttgtagtaggtgactccatcaccggtactaattactactggagttggatccgccagcccccccgggaagggcctggagtggattggatacgccttttacagtggagtcacctactacaacccgtccctcaagagccgagttaccatatctgtcgacacgtcccagaatcagttctccctggaggtgacctctgtgactgccgcagactcggccgtgtatttctgtgccagaacgcaaagcagcgcctactatactttaaactttgacttctggggccagggatccctggtcaccgtctcctcagcctccaccaagggcccatcggtcttccccctggcgccctgctccaggagcacctccgagagcacagcggccctgggctgcctggtcaaggactacttccagacgtatca

SEQ ID NO: 460626 - DNA, 509 bp, Homo sapiens; identical to SEQ ID NO: 445824
  misc_feature: HEFZJCU01DVWEY.9.14.B03.1.454.heavy.3.raw

SEQ ID NO: 460627 - DNA, 513 bp, Homo sapiens; identical to SEQ ID NO: 446452
  misc_feature: HEFZJCU01BW8VR.17.33.C11.1.454.heavy.3.raw

SEQ ID NO: 460628 - DNA, 503 bp, Homo sapiens
  misc_feature: HEFZJCU01A3IXV.48.23.C01.1.454.heavy.3.raw
agtatacatacacgaccggtgctcgatttagtacacgtgattagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtgcttttgatgtcctttgatatgtggggccaagggacaagtggtacg

SEQ ID NO: 460629 - DNA, 499 bp, Homo sapiens
  misc_feature: HEFZJCU01CITY7.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagcgtggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagatttctatagaggtgacgtacgggggcgttcg

SEQ ID NO: 460630 - DNA, 490 bp, Homo sapiens
  misc_feature: HEFZJCU01D1RB5.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtggagagatggagtcgatatgta

SEQ ID NO: 460631 - DNA, 512 bp, Homo sapiens
  misc_feature: HEFZJCU01CVH2R.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtgcgttttcttaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacgggccatatattactgtgcgaaagcaccggcagttagtcacccatactactttgctactggggccg

SEQ ID NO: 460632 - DNA, 524 bp, Homo sapiens
  misc_feature: HEFZJCU01EYIZ9.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacggctgtttattactgtgcgcggtggctgaccgctcttgactacgtggggccgggagcccggtcatcgtct

SEQ ID NO: 460633 - DNA, 511 bp, Homo sapiens
  misc_feature: HEFZJCU01B2YD6.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagtttttggctgagcgtgggttttccgttgttaggctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccaggggacg

SEQ ID NO: 460634 - DNA, 502 bp, Homo sapiens
  misc_feature: HEFZJCU01AS3A6.48.59.F04.1.454.heavy.3.raw
agtatacatacacgaccggtgctcgatttagtacacacacttagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgattgcctttgatatgtggggccaaggggacaatggt

SEQ ID NO: 460635 - DNA, 515 bp, Homo sapiens
  misc_feature: HEFZJCU01CLRN7.46.67.G01.1.454.heavy.3.raw
actagcagtacacgaccggtgctcgatttagagtatacatattgggtttggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattcttatgggcgctcccactacagtgcggccctccagagtcgagccctcatatccatagacacgtccaagaaccagtttccctgacgctgacgtctgtgaccgccgcagacacggctgtctattattgtgcgagactagccttctgtagtgggggtacttgcaacccgggatactactccaccttcggcttggacatctgggccgac

SEQ ID NO: 460636 - DNA, 519 bp, Homo sapiens
  misc_feature: HEFZJCU01D6NBJ.47.6.A06.1.454.heavy.3.raw
agctcacgtacacgaccggtgctcgatttagatctactgacagcacacaagggggggaaatactttctgagagtcctggacctcctgtgcaagaacatgaaacatctgtggttcttccttctcctggtggcagctcccacatgggtcctgtcccaggtgcagctgcaggagtcgggcccaggactggtgaagccttcggagaccctgtccctcacttgcactgtctctggtggctccatcaggagttactactggacctggcttcggcagtccccagggaagggactggagtggattgggtataattattacagtgggaccaccaactacaacccctccctcaagagtcgagtcaccatatcaatagacacgtcgaagaaccagttctccctgaagttgaactcagtgaccgctgcggacacggccgtgtattactgtgcgagccacaccgattacgatttttggagtggccttgataactggggccaggggatcctggtcaccgtctcctcagcctcc

SEQ ID NO: 460637 - DNA, 527 bp, Homo sapiens
  misc_feature: HEFZJCU01A7FG8.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctcccttgacttctggggccatggaacccggtcc

SEQ ID NO: 460638 - DNA, 514 bp, Homo sapiens
  misc_feature: HEFZJCU01BC3IB.3.34.D01.1.454.heavy.3.raw
agacgcactccacgaccggtgctcgatttagatcgtctgtgttgggtttgggggagacctggttgagcctgcggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaaatttggcgggctactacgagaacggattgggcgcctggggccaagggaccacggtcatcgtctccgcagcctccaccaagggcccatcggtcttccccctggcaccctcctccaagagcacctctgggggcacagcggccctgggctgcctggtcaaggactacttccgagtgcgtct

SEQ ID NO: 460639 - DNA, 400 bp, Homo sapiens
  misc_feature: HEFZJCU01AMX1Z.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggatgtctggggcaaagggaccgcggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 460640 - DNA, 498 bp, Homo sapiens; identical to SEQ ID NO: 449655
  misc_feature: HEFZJCU01AL9DB.48.34.D01.1.454.heavy.3.raw

SEQ ID NO: 460641 - DNA, 508 bp, Homo sapiens; identical to SEQ ID NO: 445911
  misc_feature: HEFZJCU01A9IJ6.12.78.H01.1.454.heavy.3.raw

SEQ ID NO: 460642 - DNA, 482 bp, Homo sapiens; identical to SEQ ID NO: 444503
  misc_feature: HEFZJCU01ESR1F.7.10.A10.1.454.heavy.3.raw

SEQ ID NO: 460643 - DNA, 402 bp, Homo sapiens; identical to SEQ ID NO: 444584
  misc_feature: HEFZJCU01D0RF4.10.77.G11.1.454.heavy.3.raw

SEQ ID NO: 460644 - DNA, 529 bp, Homo sapiens
  misc_feature: HEFZJCU01C5WR8.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctgggggtccagggaaccctggtcaccgtctcctcagcctccaccaaggcccatcggtcttcccctggcgcctcgctccaggagcacctccgagacg

SEQ ID NO: 460645 - DNA, 517 bp, Homo sapiens
  misc_feature: HEFZJCU01D5TLA.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggacagctgttaaaactcctactacggtctggacgtctggggccaggggaccaac

SEQ ID NO: 460646 - DNA, 513 bp, Homo sapiens; identical to SEQ ID NO: 446452
  misc_feature: HEFZJCU01A86AV.17.33.C11.1.454.heavy.3.raw

SEQ ID NO: 460647 - DNA, 504 bp, Homo sapiens
  misc_feature: HEFZJCU01EFZ2V.11.72.G06.1.454.heavy.3.raw
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcacactggaagcagagtctatgcggagagattccagggcagagtcaccctgaccacagagacatccacgaccacagtctacatggagctgtggagcctgagacctgacgacacggccctctattactgtgcgaggccctatcctacagtgaccactccacgctggtcgactctggggccac

SEQ ID NO: 460648 - DNA, 487 bp, Homo sapiens
  misc_feature: HEFZJCU01DFWU2.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggccgagttgggttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccagtctccaggcaagggctgcagtgggtggcgtttattcgaagcgatgggactcatgaacaatatgcagactccgtgaagggccgattcatcatctccagagacaactccaacaacacactggatctccaaatgaacagcctgagagtcgaggacacggccgtaatattattgtgcccttgattacta

SEQ ID NO: 460649 - DNA, 504 bp, Homo sapiens; identical to SEQ ID NO: 454912
  misc_feature: HEFZJCU01BN9BK.17.25.C03.1.454.heavy.3.raw

SEQ ID NO: 460650 - DNA, 501 bp, Homo sapiens
  misc_feature: HEFZJCU01DFKDH.19.59.F04.1.454.heavy.3.raw
tactctcgtgcacgaccggtgctcgatttagtacacacacttagggattgggggccctagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtacagcctggagggtccctgagactctcctgtgcagcctctggattcaccttcagtagttatgaaatgaattgggtccgccaggctccagggaaggggctggagtgggtttcatacattagtagtagtggtagtagcatatactacgcagactctgtgaagggccgattcaccatctccagagacagcgccaagaactcactgtatctgcaaatgaacagcctgagagccgaggacacggcagtttattactgtgcgagagagtggcaagtgagggtcggacattgtagtggt

SEQ ID NO: 460651 - DNA, 516 bp, Homo sapiens
  misc_feature: HEFZJCU01CY6LO.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctgggtggacaggatcactgggggccac

SEQ ID NO: 460652 - DNA, 498 bp, Homo sapiens
  misc_feature: HEFZJCU01ACON4.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaggcccatcggtcttcccctggcgccctgctccaggagcacctccgagagcacagcggccctgggctgcctggtcaaggactacttcctacgtcgtat

SEQ ID NO: 460653 - DNA, 513 bp, Homo sapiens
  misc_feature: HEFZJCU01DQ9LX.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgccctgctcaggagcacctctcgggggcacgagcggcccgtgggctgcctggtcaaggactacttcccata

SEQ ID NO: 460654 - DNA, 502 bp, Homo sapiens
  misc_feature: HEFZJCU01CU9NQ.14.55.E11.1.454.heavy.3.raw
cgtctagtaccacgaccggtgctcgatttagcactcgcacgttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgtattactgtgtcagagatgggagggggtggtgatccta

SEQ ID NO: 460655 - DNA, 515 bp, Homo sapiens
  misc_feature: HEFZJCU01BJ2BQ.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccgagcgggagttccaagtactcctttgacgtctgggcc

SEQ ID NO: 460656 - DNA, 513 bp, Homo sapiens
  misc_feature: HEFZJCU01C0JYC.12.27.C05.1.454.heavy.3.raw
atacgacgtacacgaccggtgctcgatttagacgcgatcgaagggtttggggtctgagagaggagcccagccctgggattttcaggtgttttcatttggtgatcaggactgaacagagagaactcaccatggagtttgggctgagctggctttttcttgtggctattttaaaaggtgtccagtgtgaggtgcaactggtggagtctgggggaggcttggtacagccgggggggtccctgagactctcctgtgcaggctctggattcatctttaacaactatgccatgagctgggtccgccaggctccaggaaggggctggagtgggtctcagctattagtaatagtggtgatagcacatcctacgcagactccgtgaagggccgcttcaccatctccagagacaattccaagaacacgctgtatctccaaatgaacagtctcagagccgaggacacgggccatatattactgtgcgaaagacacagccgcagtttgggggagtcatcgtcctt

SEQ ID NO: 460657 - DNA, 523 bp, Homo sapiens
  misc_feature: HEFZJCU01BT5H6.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggacggtttttgggggcgcggactcctcttgagatctggggccagggggacaagtgtcaccgtctcttcag

SEQ ID NO: 460658 - DNA, 510 bp, Homo sapiens
  misc_feature: HEFZJCU01D8IVS.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgggtcccagaaccagttctccctgacagtgagttatatgaccgccgcagacacggccgtgtattactgtgcgagagaggccgttattttaggaccagctgttaaaaactcctactacggtctggacgtcgtgggcc

SEQ ID NO: 460659 - DNA, 491 bp, Homo sapiens
  misc_feature: HEFZJCU01BKUDO.11.13.B02.1.454.heavy.3.raw
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttccccctggcgccctgctccaggagcacctccgagagcacagcggccctgggctgcctggtcaaggactacttccgtatctctg

SEQ ID NO: 460660 - DNA, 499 bp, Homo sapiens; identical to SEQ ID NO: 446805
  misc_feature: HEFZJCU01BPEEV.3.20.B09.1.454.heavy.3.raw

SEQ ID NO: 460661 - DNA, 509 bp, Homo sapiens
  misc_feature: HEFZJCU01AFJ6E.19.67.G01.1.454.heavy.3.raw
tactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctggtggacagatcactc

SEQ ID NO: 460662 - DNA, 510 bp, Homo sapiens
  misc_feature: HEFZJCU01AMGN6.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagaacacttccaacaacatcttgtatcttcacatgcacaatctgagagtcgacgacacgggccacctattattgtgcgcgacatgactacgctcaattctgggccagggagcccaggtcaccgtctccccagcctccaccaagggcccatcggtcttccccctggcgccctgctccaggagcacctccgagacgcacagcggccctcgggctgcctggtccaaggactacttcccactacta

SEQ ID NO: 460663 - DNA, 499 bp, Homo sapiens
  misc_feature: HEFZJCU01DQ5AS.11.57.F02.1.454.heavy.3.raw
cgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccagccgggggggtccctgagactctcctgtctagtctctggattcgccttcagtgactatgccatgaagtgggtccgccaggctccaggtaaggggctggaatggatttcatacattagcagtagtggtgcgaccatatactacgcagactctgtgaagggccgattcatcatctccagagacaatggcaacaactcactgtatctggaaatcaacagcctgagagtcgaggacacggctgtatattattgtgcgagacgcccctacggtgtacg

SEQ ID NO: 460664 - DNA, 503 bp, Homo sapiens; identical to SEQ ID NO: 450415
  misc_feature: HEFZJCU01DZPS7.15.55.E11.1.454.heavy.3.raw

SEQ ID NO: 460665 - DNA, 387 bp, Homo sapiens
  misc_feature: HEFZJCU01B0GTP.13.86.H09.1.454.heavy.3.raw
tcacgtactacacgaccggtgctcgatttagtgctatagacttgggtttgggtggatgggatgggtcagcgctgacactggacacacagagtatgcacagaagttccagggcagagtcaccatcaccacagacatatccacgaacacagcctacatggaggtgaggagcctgagatctgacgacacggccgtttattactgtgcgagagagtctacagtaactgccgaaaactggttcgacccctggggccagggaaccctggtcaccgtctcctcagcctccaccaagggcccatcggtcttccccctggcaccctcctccaagagcacctctgggggcacagcggccctgggctgcctggtcaaggactacttcctagtacgtga

SEQ ID NO: 460666 - DNA, 504 bp, Homo sapiens
  misc_feature: HEFZJCU01CZX4O.48.81.H04.1.454.heavy.3.raw
agtatacatacacgaccggtgctcgatttagtagtgtagattcgcggggatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcgcggggaggtggacggagctcggttttcggagttatcatctactactttg

SEQ ID NO: 460667 - DNA, 517 bp, Homo sapiens
  misc_feature: HEFZJCU01CQJEP.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctagttaaaactcctactacggtctggacgtctgtggccaggggaccg

SEQ ID NO: 460668 - DNA, 492 bp, Homo sapiens; identical to SEQ ID NO: 444827
  misc_feature: HEFZJCU01ED54X.4.28.C06.1.454.heavy.3.raw

SEQ ID NO: 460669 - DNA, 379 bp, Homo sapiens; identical to SEQ ID NO: 452568
  misc_feature: HEFZJCU01AN36R.40.13.B02.1.454.heavy.3.raw

SEQ ID NO: 460670 - DNA, 479 bp, Homo sapiens; identical to SEQ ID NO: 447128
  misc_feature: HEFZJCU01C521U.4.37.D04.1.454.heavy.3.raw

SEQ ID NO: 460671 - DNA, 527 bp, Homo sapiens; identical to SEQ ID NO: 456799
  misc_feature: HEFZJCU01EVSGR.17.34.D01.1.454.heavy.3.raw

SEQ ID NO: 460672 - DNA, 510 bp, Homo sapiens; identical to SEQ ID NO: 454674
  misc_feature: HEFZJCU01EGOWX.7.28.C06.1.454.heavy.3.raw

SEQ ID NO: 460673 - DNA, 525 bp, Homo sapiens
  misc_feature: HEFZJCU01EC8KX.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattacttgtgcgagagattcgagtggttcgggggacctcaccctggttctacttcgtatctctggggcc

SEQ ID NO: 460674 - DNA, 509 bp, Homo sapiens
  misc_feature: HEFZJCU01B1I10.48.59.F04.1.454.heavy.3.raw
agtatacatacacgaccggtgctcgatttagtacacacacttagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgattatgttgggggccgaaggggacaagtggtccg

SEQ ID NO: 460675 - DNA, 509 bp, Homo sapiens
  misc_feature: HEFZJCU01ELYFE.12.30.C08.1.454.heavy.3.raw
atacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtggctccatcagcagtggtgattattactggagttggatccgccagtccccagggaagggcctggagtggattgggtacatctatcacagtgggagcacctactacatcccgtccctgaagagtcgaattacgatgtcagtaaacacgtctaggaaccagttctccctgaagctgaggtctgtgactgccgcagacacggccgtctactactgtgccaggtgggctttgcgccagtggttcagagatgatcgcttcgattcggtggggccagggaatttcg

SEQ ID NO: 460676 - DNA, 490 bp, Homo sapiens
  misc_feature: HEFZJCU01DDUQM.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaaggcccatcggtcttcccctggcgccctgctccaggagcacctccgagagcacagcggccctgggctgcctggtcaaggactacttcccacgagagta

SEQ ID NO: 460677 - DNA, 517 bp, Homo sapiens
  misc_feature: HEFZJCU01EMSPB.19.26.C04.1.454.heavy.3.raw
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctggggccgaagggaccacggtcatcgtctccccacgcctccaccaagggcccatccggtcttccccctcggccgccctcgcctccacgga

SEQ ID NO: 460678 - DNA, 519 bp, Homo sapiens; identical to SEQ ID NO: 446650
  misc_feature: HEFZJCU01DSON6.13.76.G10.1.454.heavy.3.raw

SEQ ID NO: 460679 - DNA, 506 bp, Homo sapiens
  misc_feature: HEFZJCU01EANB2.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctgggccagggaaccctggtcaccgtctcctcagcctccaccaagggcccatccggtcttccccctggcaccctcctccaagagcacctctggggcacagcgcctggctgcctggtcaaggactacttccgtact

SEQ ID NO: 460680 - DNA, 394 bp, Homo sapiens
  misc_feature: HEFZJCU01DTOND.18.31.C09.1.454.heavy.3.raw
tacgagtatgcacgaccggtgctcgatttagacgtctcatcaaggaaggaaggggctggagtggatttcatacattagtagtgctggcaataccatcctctacgcagactctgtgaagggccggttcagcgtctccagggacaacgccaataacttctgtttctgcaaatgaacagcctgagagccgaggactcggccacatattactgtgcgagaggaattttgactggttattcctactactttgactactggggccagggcactccggtcaccgtctcctcagcctccaccaagggcccatcggtcttcccctggcaccctcctccaagagcacctctgggggcacagcggccctgggctgcctggtcaaggactacttcccatactcgta

SEQ ID NO: 460681 - DNA, 507 bp, Homo sapiens
  misc_feature: HEFZJCU01ESVZR.48.44.D11.1.454.heavy.3.raw
agtatacatacacgaccggtgctcgatttagcgcagtacgaagggaggcttggtccagcctgggggtccctgaaactctcctgtacagcctctgggttcgccttcacagcctctgggttcagcttcagtgcctctgctatgcactgggtccgccaggctttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggactacttcctatgtatacgt

SEQ ID NO: 460682 - DNA, 513 bp, Homo sapiens
  misc_feature: HEFZJCU01A5XLX.22.36.D03.1.454.heavy.3.raw
acatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacagccgggggggtccctgacactctcctgtgcagcctctggattcacagtcagcagcaatgccatgagttgggtccgccaggctccagggaaggggttgcagtgggtctcgggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaagacctctattttgggccgcggccgactactgggccgac

SEQ ID NO: 460683 - DNA, 510 bp, Homo sapiens
  misc_feature: HEFZJCU01CLPYM.48.67.G01.1.454.heavy.3.raw
agtatacatacacgaccggtgctcgatttagagtatacatattgggtttggggggtctcagagaggagccttagccctggactccaaggcctttccacttggtgatcagcactgagcacagaggactcaccatggaattggggctgagctgggttttccttgttgctattttagaaggtgtccagtgtgaagtgcagctggtggagtctgggggaggcttggtccagcctggggggtccctaagactctcctgtgcagcctctggattcacctttagtacctattggatgacctggatgaacagcctgagagccgaggacgcggctgtgtattactgtgcgagagatgcgaatccctctgatagtaatggtcgttattatgatgcttttgatatgtggggccaagggacaacggtcaccgtctcttcagcctccaccaagggcccatcggtcttcccctggcgccctgctccagagcacctccgagagcacagcggccctgggctgtccg

SEQ ID NO: 460684 - DNA, 531 bp, Homo sapiens
  misc_feature: HEFZJCU01CZE01.16.87.H10.1.454.heavy.3.raw
tgtactactccacgaccggtgctcgatttagcagtactgcgttgggtttgggggcccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtggaacagttatggttggggggagttggggtttttttttcgttactacgggatc

SEQ ID NO: 460685 - DNA, 526 bp, Homo sapiens
  misc_feature: HEFZJCU01CRETP.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttggttctggggccaggggaccctggtcatcgtctcccagcctccaccaaggcccatcggtcttcccctggcgcctccg

SEQ ID NO: 460686 - DNA, 532 bp, Homo sapiens
  misc_feature: HEFZJCU01CH02Q.12.85.H08.1.454.heavy.3.raw
  modified_base (363)..(363): a, c, t, g, unknown or other
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggcttttcttgtggctttttaaaaggtgcccagtgtgaggtgcaactgttggagtctggggaggcttggtacagccggggggtccctgagactctcctgtgcagcctctggattcaatttaacagcttgccatgggctgggtccgccaggctccagggaaggggctggagtgggtctcgaatataatgaagggtgataacacatactatgcgactcngtaaggggccgttcaccatctccagagacaattccaagaaaacactgtatctgcaattaaccagcctagagagtcgaggacacggccctttattactgtgcgaaggatcgccctataatggtggctggatcggggagtttgggttcctggggccaggggaaccctgggt

SEQ ID NO: 460687 - DNA, 490 bp, Homo sapiens; identical to SEQ ID NO: 455547
  misc_feature: HEFZJCU01CRSOM.18.70.G04.1.454.heavy.3.raw

SEQ ID NO: 460688 - DNA, 528 bp, Homo sapiens
  misc_feature: HEFZJCU01BNWMO.14.35.D02.1.454.heavy.3.raw
cgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggccacagcctacatggagttgagcggcctgagatttgacgacacggccttctattactgtgcgagagaactcgctacgataaatatgcccttgcctcttgactactggggccagggaaccctggtcaccgtctcctcagcctccaccaagggcccatcggtcttccccctggcaccctcctccaagagcacctctgggggcacagcggcctgggctgcctggtcaaggactacttccg

SEQ ID NO: 460689 - DNA, 484 bp, Homo sapiens
  misc_feature: HEFZJCU01BVWDL.52.8.A08.1.454.heavy.3.raw
  modified_base (432)..(432): a, c, t, g, unknown or other
cgcagtacgacacgaccggtgctcgatttagcatactctacagggggctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaaggccgattcatcatctcagagacaactccgagacacgctgtatctgcaaatgaaacnggctgagagtctagaagacacggctgtatattactgtcgacgaactttaacg

SEQ ID NO: 460690 - DNA, 516 bp, Homo sapiens
  misc_feature: HEFZJCU01DM48Q.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccagcgggagtccaagtacttcc

SEQ ID NO: 460691 - DNA, 396 bp, Homo sapiens; identical to SEQ ID NO: 444469
  misc_feature: HEFZJCU01DB2YB.47.46.E02.1.454.heavy.3.raw

SEQ ID NO: 460692 - DNA, 518 bp, Homo sapiens; identical to SEQ ID NO: 444718
  misc_feature: HEFZJCU01C6E3H.9.34.D01.1.454.heavy.3.raw

SEQ ID NO: 460693 - DNA, 531 bp, Homo sapiens
  misc_feature: HEFZJCU01B06KG.16.9.A09.1.454.heavy.3.raw
tgtactactccacgaccggtgctcgatttagcgagacgcgcagggggagagaggggcccagccctgggattttcaggtgttttcatttggtgatcaggactgaacagagagaactcaccatggagtttgggctgagctggctttttcttgtggctattttaaaaggtgtccagtgtgaggtgcagttggtggactctgggggagacctgataccgcctggggggtccctgagactctcctgtacagcctctggattcacctttaggagccatgccatgagctgggtccgccaggctccagggaaggggctggagtgggtctctactattactgctagtggtaatcatgcatactatgcagactccgtgaagggccggttcaccttcaccagagacaattccaagaacacgctctatctgcaattgaccagcctgagcgccgaggacacggccatgtattactgtactaaatcgcgggtggccgcggccggtaccgtccggatggttttgatttctggggtccgaagggaac

SEQ ID NO: 460694 - DNA, 536 bp, Homo sapiens
  misc_feature: HEFZJCU01CPQE3.52.49.E05.1.454.heavy.3.raw
cgcagtacgacacgaccggtgctcgatttagagcgactagcaacacacaaaggggacccaaaaaccacacccctccttgggagaatcccctagatcacagctcctcaccatggcctggacctggagcatccttttcttggtggcagcagcaacaggtgcccactcccaggttcacctggtgcagtcgggaggtgaggttaagaggcctggggcctcagtgaaggtcgcctgcaaggcttcaggttacaccctttccacgtctggtatcagttgggtgcgacaggcccccggacaagggcttgagtggatgggatggatcagcggtgacaacggcaacacaaattatggacagaagttccagggcagagtcaccatgaccgcggacacatccacgaacacagcctacatggagctgaggagcctaagatctgacgacacggccgtttattactgtgtgagagattttagggacctcggcccttgggggagttatcgttactttgactacgtggggccagggacccaggtcaccgtct

SEQ ID NO: 460695 - DNA, 511 bp, Homo sapiens
  misc_feature: HEFZJCU01CMK0G.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagccagggaactctggtcaccgtctcctcagcctccaccaagggcccatcggtcttcccctggcgccctgctccaggagcacctccgagagcacagcggccctggg

SEQ ID NO: 460696 - DNA, 473 bp, Homo sapiens
  misc_feature: HEFZJCU01AWE5S.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggccatcggtcttcccctcggcgccctgctccaggagcacctccgagagcacagcggcccgtcgggctcgcctggtcaaggactacttccctacagtgct

SEQ ID NO: 460697 - DNA, 519 bp, Homo sapiens
  misc_feature: HEFZJCU01B46WC.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacacccttatctgcaaatagacagcctgagaccagacgacacggctgtctattattgcgcgagagagacacacgaacctactggccaatactatgggggcttgttctggggccaggggaccctggtcatcgtctccccagcctccaccaaggcccatcggtcttcccctggcg

SEQ ID NO: 460698 - DNA, 514 bp, Homo sapiens
  misc_feature: HEFZJCU01B9WM6.49.86.H09.1.454.heavy.3.raw
agtcgagagacacgaccggtgctcgatttagtgctatagacttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatcttttgatgattatgccatgcactggatccgtcaagctccggggaagggtctggagtgggtctctcttattaattgggatggtggtatcacctactatgcagactctgtgaagggtcgattcaccatctccagagacaacagcagaaactccctgtatctgcaaatgaacagtctcagaggtgaggacaccgccttctactactgtgcaaaagatttacggtgaccacacctattttgacctac

SEQ ID NO: 460699 - DNA, 530 bp, Homo sapiens
  misc_feature: HEFZJCU01BE8BH.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgactttggggccagggaaccctggtcaccgtctcctcagcctccaccaagggcccatcggtcttccccctggcaccctcctccaagagcacctctggggcacagcggcctgggctgcctc

SEQ ID NO: 460700 - DNA, 502 bp, Homo sapiens
  misc_feature: HEFZJCU01EI1Y6.48.12.B01.1.454.heavy.3.raw
agtatacatacacgaccggtgctcgatttagtagtgtagattccgcgggcacgaccggtgctcgatttagtagtgtagattcgcgggggcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcgcgggga

SEQ ID NO: 460701 - DNA, 504 bp, Homo sapiens
  misc_feature: HEFZJCU01EM6WL.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccagatccgggtgagcctaggcagcggcctttgactttcgtc

SEQ ID NO: 460702 - DNA, 534 bp, Homo sapiens
  misc_feature: HEFZJCU01EFY9Q.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaatggctgtgtttatggggccagggagccctggtcaccg

SEQ ID NO: 460703 - DNA, 498 bp, Homo sapiens; identical to SEQ ID NO: 449655
  misc_feature: HEFZJCU01DTVOK.48.34.D01.1.454.heavy.3.raw

SEQ ID NO: 460704 - DNA, 496 bp, Homo sapiens; identical to SEQ ID NO: 444697
  misc_feature: HEFZJCU01BGT72.16.37.D04.1.454.heavy.3.raw

SEQ ID NO: 460705 - DNA, 553 bp, Homo sapiens
  misc_feature: HEFZJCU01EAWIH.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctgggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggatacagtggcagctccaagtactactttgacttctggggccagggaaccctggtcaccgtctcctcacgtcctccaccaagggcccacgtccggtcctttccccccgttcggcccgtccccgtcgtcctcccagggaacgccgacctccgaacgac

SEQ ID NO: 460706 - DNA, 516 bp, Homo sapiens
  misc_feature: HEFZJCU01ACRLJ.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctcaccaagggcccatcc

SEQ ID NO: 460707 - DNA, 395 bp, Homo sapiens; identical to SEQ ID NO: 444517
  misc_feature: HEFZJCU01APOYB.16.68.G02.1.454.heavy.3.raw

SEQ ID NO: 460708 - DNA, 501 bp, Homo sapiens; identical to SEQ ID NO: 449500
  misc_feature: HEFZJCU01AJGIV.17.25.C03.1.454.heavy.3.raw

SEQ ID NO: 460709 - DNA, 500 bp, Homo sapiens
  misc_feature: HEFZJCU01ETIK0.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctgtctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaagggac

SEQ ID NO: 460710 - DNA, 508 bp, Homo sapiens
  misc_feature: HEFZJCU01D7GW4.12.78.H01.1.454.heavy.3.raw
atacgacgtacacgaccggtgctcgatttagtgtgagtagtttgggtttgggggaggcttggtacagcctggggggtccccgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaacgggcccatcggtcttcccctggcaccctcctccaagagcacctctggggcacagcggccctgggctgcctggtcaaggctacttcctacgtcgtat

SEQ ID NO: 460711 - DNA, 484 bp, Homo sapiens; identical to SEQ ID NO: 449584
  misc_feature: HEFZJCU01EPCFV.10.35.D02.1.454.heavy.3.raw

SEQ ID NO: 460712 - DNA, 534 bp, Homo sapiens
  misc_feature: HEFZJCU01AVTMZ.13.35.D02.1.454.heavy.3.raw
tcacgtactacacgaccggtgctcgatttagcacacgatagttgggtttgggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtctgggggggcttggttaagcctggggggtccctcagactctcctgtgcaacctctggattcattttctctgacgcctggttgagctgggtccgccaggctcccgggaaggggctggagtgggttggccgtattaaaggtagaagacatggtcggacaacagactacagtgttcccgtgaaaggcagattcactatctcaagagatgactcaaaagaaatgatatatctgcaaatgaacaacctgaaaagcgaggacacaggcgtgtattactgtaccacagatgggccagatgcaaatggccgcgacgagttcgactactgggggcccggg

SEQ ID NO: 460713 - DNA, 492 bp, Homo sapiens
  misc_feature: HEFZJCU01ATAJF.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattc

SEQ ID NO: 460714 - DNA, 429 bp, Homo sapiens; identical to SEQ ID NO: 447657
  misc_feature: HEFZJCU01BUCML.40.34.D01.1.454.heavy.3.raw

SEQ ID NO: 460715 - DNA, 512 bp, Homo sapiens; identical to SEQ ID NO: 450914
  misc_feature: HEFZJCU01EJ9AG.15.67.G01.1.454.heavy.3.raw

SEQ ID NO: 460716 - DNA, 497 bp, Homo sapiens
  misc_feature: HEFZJCU01CHU98.53.72.G06.1.454.heavy.3.raw
cgcgtatacacacgaccggtgctcgatttagctacgactgcaagggaaagggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcacctagtggagtctgggggaggcgtcgtccaccctggggggtccctgagactctcctgtgcagcctctggattcaccttcagagtctatggcatgcactgggtccgccaggctccaggcaaggggctggagtgggtggcacttatatcagatgatggaagtgatacatactatggagactccgtgaagggccgattcaccatctcgagagacaattccaggaacacgctgtatctgcaaatgaacggcctgagagctgaggacacggctgtgtattactgtgcgaaacggtttgagtgggaa

SEQ ID NO: 460717 - DNA, 508 bp, Homo sapiens
  misc_feature: HEFZJCU01DSXXP.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtccttccccctggccgccctgctccaggagcacctccgagagcacagcggccctgggctgcctggtcaaggactacttcccactacta

SEQ ID NO: 460718 - DNA, 512 bp, Homo sapiens
  misc_feature: HEFZJCU01A9BIS.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggccgccctgctccaggagcacctccgagagcacagcggccctggg

SEQ ID NO: 460719 - DNA, 508 bp, Homo sapiens
  misc_feature: HEFZJCU01B3YZU.5.6.A06.1.454.heavy.3.raw
atcagacacgcacgaccggtgctcgatttagatctactgacaggggtctcagagaggtgccttagccctggattccaaggcatttccacttggtgatcagcactgaacacagaggactcaccatggagttggggctgcgctgggttttccttgttgctattttagaaggtgtccagtgtgaggtgcagctggtggagtctgggggaaagttggtgcagcctggggagtccctgagactctcctgtgaaggcgctggatttaccctcagttcctataaaatgggctgggtccgccaggctccagggaaggggctggagtggctttcaatcatctacagtagtgggagtgtcatttattacgcggactctgtgaagggccgattcaccatttccagagacaacgccaagaactcactgtatctgcaaatgaacagcctgagagccgaggacacggctgtatattactgtgcgagagatctgggggccaacagttggccctactttgtacg

SEQ ID NO: 460720 - DNA, 524 bp, Homo sapiens
  misc_feature: HEFZJCU01CTMR5.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccagggggaccctggtcatcgtctccccagcctccaccaagggcccatcggtcttccccctggccg

SEQ ID NO: 460721 - DNA, 529 bp, Homo sapiens
  misc_feature: HEFZJCU01AKON6.13.28.C06.1.454.heavy.3.raw
tcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagcctggggggtccctgagactctcctgtgtagcctctggatttgtttttagtgactattggatgagttgggtccgccaggctccagggaaggggctggagtgggtggccaacataaagtacgatgaagttgagataaattatttggactctgtgaagggccgattcaccatctcgagggacaacgccaagaactcgctgtatctgcaaatggagagcctgagagccgaggacacggctgtatattattgtgtgagattagcgcactactttgactactggggccgacggtaccgtgtcaccgt

SEQ ID NO: 460722 - DNA, 531 bp, Homo sapiens
  misc_feature: HEFZJCU01BKFEN.17.34.D01.1.454.heavy.3.raw
cgtagactagcacgaccggtgctcgatttagatcgtctgtgttgggtttggggatcacaaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctcccttcgacttctggggccatggaaccccggtccg

SEQ ID NO: 460723 - DNA, 477 bp, Homo sapiens; identical to SEQ ID NO: 444659
  misc_feature: HEFZJCU01D06X5.16.10.A10.1.454.heavy.3.raw

SEQ ID NO: 460724 - DNA, 498 bp, Homo sapiens
  misc_feature: HEFZJCU01AKZ6W.4.57.F02.1.454.heavy.3.raw
agcactgtagcacgaccggtgctcgatttagctcgatatagttgggttggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctcgctccaggagcacctccgtgggggcacgagcgggccctcgggcgtgcctggtcaaggactacttccctacagtgct

SEQ ID NO: 460725 - DNA, 511 bp, Homo sapiens
  misc_feature: HEFZJCU01CK0EO.21.4.A04.1.454.heavy.3.raw
  modified_base (457)..(457): a, c, t, g, unknown or other
  modified_base (484)..(484): a, c, t, g, unknown or other
  modified_base (492)..(492): a, c, t, g, unknown or other
tcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtgaccacaacatggactgggtccgccaggctccgagggaaggggctggagtgggtcggccgtattacaaggaagctaacagttacagtacagaatacggcgcgtctgtagaaaggaggttcaccatctcaagagatgattcaaagaactcactgtatctgcaaatgaacagcctagaaaaccgnggaacacggcgtgtattattgtggtanaacaaagngtggatggtggtggtagct

SEQ ID NO: 460726 - DNA, 403 bp, Homo sapiens
  misc_feature: HEFZJCU01EBSAH.53.29.C07.1.454.heavy.3.raw
cgcgtatacacacgaccggtgctcgatttagagtgctacgaagggaaagggcttgagtgggtggcagttatgtactatgatggaagtaataaatattatgcagacttcgtgaagggccgattcaccatctccagagacagttccaaggacatcctgtatctccaaatgaacagcctgagacccgaggacacggctgtctactactgtgcgagggggggactagatttggtggctacgatcacccccatttttttgacttctggggccagggaaccctggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 460727 - DNA, 515 bp, Homo sapiens
  misc_feature: HEFZJCU01BJE4X.9.33.C11.1.454.heavy.3.raw
tgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaaggaggggggatacgagtggcagctccaagtactactttgtac

SEQ ID NO: 460728 - DNA, 503 bp, Homo sapiens
  misc_feature: HEFZJCU01DMOCX.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggtggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgacttctc

SEQ ID NO: 460729 - DNA, 511 bp, Homo sapiens
  misc_feature: HEFZJCU01B9OZ9.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgcaaactccaggtaaggggctggtgtgggtctcacgtatcaatcctgatggcagtgttataaattatgcggactccgtgaggggccgattcagcatctccagagacaacggcaagagtatactgtatctggaaatgaacatctgagagtcgacgatacggctgtctatcattgtgttttcgatgccttcggtccgcgggacttcgtggggccacgggaaccctc

SEQ ID NO: 460730 - DNA, 520 bp, Homo sapiens
  misc_feature: HEFZJCU01BF2RN.4.33.C11.1.454.heavy.3.raw
agcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatgaacagcctgaagaccgaggacacagccgtctattactgtgtttagggtagttttacgtatttttggtagtggattatttaa

SEQ ID NO: 460731 - DNA, 507 bp, Homo sapiens
  misc_feature: HEFZJCU01ASWSK.4.25.C03.1.454.heavy.3.raw
agcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgtttctgcaaatgaacagcctgagagccgaggacacggctgtgtatcactgtgtcagagatgccgagggcggttacccctctggttccttcgacagttatggtatggacgtctggggcctagggactacggtcaccgtctcctcagcctccaccaaggcccatcggtcttcccc

SEQ ID NO: 460732 - DNA, 510 bp, Homo sapiens
  misc_feature: HEFZJCU01DKZJ7.8.34.D01.1.454.heavy.3.raw
ctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaaggaggggggaaccagcgggagttccaagtactcctttg

SEQ ID NO: 460733 - DNA, 517 bp, Homo sapiens; identical to SEQ ID NO: 445616
  misc_feature: HEFZJCU01CP4E7.9.34.D01.1.454.heavy.3.raw

SEQ ID NO: 460734 - DNA, 508 bp, Homo sapiens
  misc_feature: HEFZJCU01AHCRY.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaagtagacgtggtagttccggggggacgacatgacaccg

SEQ ID NO: 460735 - DNA, 312 bp, Homo sapiens
  misc_feature: HEFZJCU01CKCU2.7.10.A10.1.454.heavy.3.raw
cgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggccctggctgcctggtcaaggactacttcctagagacacg

SEQ ID NO: 460736 - DNA, 501 bp, Homo sapiens
  misc_feature: HEFZJCU01ETMJ4.48.59.F04.1.454.heavy.3.raw
agtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtgggccaagggacaatggtcacgt

SEQ ID NO: 460737 - DNA, 513 bp, Homo sapiens
  misc_feature: HEFZJCU01DVSIS.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctgggccaggaaccctggtcaccgtctcctcagcctccaccaaggccatcggtcttcccctgcaccctcctccaagagcacctctgggggcacagcggccctgggctgcctggtcaaggactacttccgagtagtaca

SEQ ID NO: 460738 - DNA, 508 bp, Homo sapiens; identical to SEQ ID NO: 445594
  misc_feature: HEFZJCU01B2A21.17.25.C03.1.454.heavy.3.raw

SEQ ID NO: 460739 - DNA, 508 bp, Homo sapiens
  misc_feature: HEFZJCU01DENV4.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgttcatctgagggcagtgttcaatggtatgctgacgccgtgaagggccgattcaccatctccagagacaactccaggaacacaatgtatttggacctgaacagcctaagtcctgaggacacgggtgtatactactgtacgaaggagggggaaccagcgggagttccaagtactctttg

SEQ ID NO: 460740 - DNA, 501 bp, Homo sapiens
  misc_feature: HEFZJCU01A2TZG.21.70.G04.1.454.heavy.3.raw
tcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaccagttctccctgaagctgaactctctgaccgccgcagacgcgggtatatattattgtgcgagacatagtggtattggctactcgccctattacggtatggacgtctggggccaagggaccgcagtcaccgtctcctcagcctccaccaagggcccatcggtcttcccctggcgccctgctccaggagcacctccgagagcacagcggccctgggctgcctggtcaaggactacttcccgagcgacga

SEQ ID NO: 460741 - DNA, 515 bp, Homo sapiens
  misc_feature: HEFZJCU01DXFHS.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcgggggaggttattagtccctactttgactactggggccaggggaactctggtcaccgtctccgcagcctcaccaagggccc

SEQ ID NO: 460742 - DNA, 483 bp, Homo sapiens
  misc_feature: HEFZJCU01DQ5DR.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggagcgtggcccagcctgggaggtccctcagactctcctgtgcagcgtctggattcagtttcgctacacatggcatgcactgggtccgccagtctccaggcaaggggctgcagtgggtggcgtttatcgaagcgatgggactcatgaacaatatgcagactccgtgaagggccgattcatcatctccagagacaactccaacaacacactggatctccaaatgaacagcctgagagtcgagacacggccgtatattatgtgcccttgattacta

SEQ ID NO: 460743 - DNA, 486 bp, Homo sapiens
  misc_feature: HEFZJCU01A2N8N.22.86.H09.1.454.heavy.3.raw
acatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgttctccaaatgaacagcctgagaggcgaggacacggcagtgtattactgtgcgagagatcgacatgacg

SEQ ID NO: 460744 - DNA, 470 bp, Homo sapiens; identical to SEQ ID NO: 444866
  misc_feature: HEFZJCU01CNLQI.4.36.D03.1.454.heavy.3.raw

SEQ ID NO: 460745 - DNA, 477 bp, Homo sapiens
  misc_feature: HEFZJCU01ERK79.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacacagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 460746 - DNA, 492 bp, Homo sapiens; identical to SEQ ID NO: 444827
  misc_feature: HEFZJCU01BRJ35.4.28.C06.1.454.heavy.3.raw

SEQ ID NO: 460747 - DNA, 517 bp, Homo sapiens; identical to SEQ ID NO: 448515
  misc_feature: HEFZJCU01ETSGY.7.78.H01.1.454.heavy.3.raw

SEQ ID NO: 460748 - DNA, 396 bp, Homo sapiens; identical to SEQ ID NO: 444469
  misc_feature: HEFZJCU01AT742.47.46.E02.1.454.heavy.3.raw

SEQ ID NO: 460749 - DNA, 340 bp, Homo sapiens
  misc_feature: HEFZJCU01DY83Q.47.38.D05.1.454.heavy.3.raw
agctcacgtacacgaccggtgctcgatttagtatctgatagttgggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggaactacttcctacgtgagct

SEQ ID NO: 460750 - DNA, 527 bp, Homo sapiens; identical to SEQ ID NO: 446200
  misc_feature: HEFZJCU01AVNLY.7.70.G04.1.454.heavy.3.raw

SEQ ID NO: 460751 - DNA, 502 bp, Homo sapiens
  misc_feature: HEFZJCU01B2J0G.48.67.G01.1.454.heavy.3.raw
agtatacatacacgaccggtgctcgatttagagtatacatattgggtttgggtctcagagaggtgccttagccctggattccaaggcatttccacctggtgatcagcactgaacacagaggactcaccatggaggtggggctgtgctgggtgttccttgttgctattttagaaggtgtccaatgtgaggtgcagctggtggaatctgggggtgccttggtgccgccgggggggtccctgagactctcctgtgtagcctccggattcacatttagttcccatagtatggtctgggtccgccaggctccagggaagggtctagagtggatttcatacattaggagtggcagtagtcccatatactacgcagactctgtgaagggccgattcatcatctccagagacaatgccgagaactcactgtttctgcaaatgaacagcctgagagacgaggacacggctgtttattactgtgcgagagtgcggatttcacctacacaggg

SEQ ID NO: 460752 - DNA, 396 bp, Homo sapiens
  misc_feature: HEFZJCU01CKEFI.4.79.H02.1.454.heavy.3.raw
agcactgtagcacgaccggtgctcgatttagtgtcacacgaagggaaggggctggagtggctttcatacattgatagtagtgggaagatcatatactacgcagactctgtgaagggccgattcaccgtctccagagacaacgccaacaactcactgtttctgcaaatggacagcctgagagccgaggactcggctgtttattactgtgcgagagattccaggagtttgatgctagcgagggcctactatgactactggggccagggaaccaaggtcaccgtctcctcagcctccaccaagggcccatcggtcttcccctggcgccctgctccagagcacctccgagagcacagcggccctgggctgcctggtcaaggactacttccctacagtgct

SEQ ID NO: 460753 - DNA, 395 bp, Homo sapiens; identical to SEQ ID NO: 448398
  misc_feature: HEFZJCU01AJXG2.47.46.E02.1.454.heavy.3.raw

SEQ ID NO: 460754 - DNA, 504 bp, Homo sapiens
  misc_feature: HEFZJCU01EX0NY.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatgacagcctaagagttgaggacacggctgtttattactgtacgaaagagggggatacgagtggcagctccaagtacta

SEQ ID NO: 460755 - DNA, 482 bp, Homo sapiens
  misc_feature: HEFZJCU01EG1CL.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagcctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagacggccccatacg

SEQ ID NO: 460756 - DNA, 516 bp, Homo sapiens
  misc_feature: HEFZJCU01A2VVY.51.37.D04.1.454.heavy.3.raw
cgatcgtatacacgaccggtgctcgatttagtagcatactgttgggttttccttgttgctattatagaaggtgtccagtgtcaggtgcagctggtggaatctgggggaggcttggtcaagcctggagggtccctgagactctcctgtgcagcctctggattcaccttcagtggctacttcatgagctggatccgccaggctccagggaaggggctgcagtgggtctcacatattagtgctaatgggagaaccacattctacgcagactctgtgaagggccgattctccatctccagggacaacgccaagaactcactgtatctgcaaatgaacagtctaagagccgaagacacggccgtgtacttctgtgcgagtgtgggagaggactacggtgacacggagcctttctcctactacttcggtgtggacgtctggggccaagggaccacggtcaccgtctcctcagcctccaccaagggcccatcggtcttcccctggccaccctcctccaagacg

SEQ ID NO: 460757 - DNA, 398 bp, Homo sapiens; identical to SEQ ID NO: 444798
  misc_feature: HEFZJCU01EMV7U.4.60.F05.1.454.heavy.3.raw

SEQ ID NO: 460758 - DNA, 502 bp, Homo sapiens; identical to SEQ ID NO: 450016
  misc_feature: HEFZJCU01BHE0F.17.10.A10.1.454.heavy.3.raw

SEQ ID NO: 460759 - DNA, 505 bp, Homo sapiens
  misc_feature: HEFZJCU01B5GTF.10.38.D05.1.454.heavy.3.raw
catagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccgagggaaggggctggagtgggtctcagttattgaaacagatggcactacatattattctgactccgtgaagggccggttcaccctctccagagacacttccaacaacatcttgtatcttcacatgcacaatctgagacgtcgacgacacggccacctattattgtgcgcgacatgactacgctcaattctcggggccg

SEQ ID NO: 460760 - DNA, 479 bp, Homo sapiens; identical to SEQ ID NO: 447128
  misc_feature: HEFZJCU01BN0Y6.4.37.D04.1.454.heavy.3.raw

SEQ ID NO: 460761 - DNA, 481 bp, Homo sapiens; identical to SEQ ID NO: 448054
  misc_feature: HEFZJCU01D05LJ.22.36.D03.1.454.heavy.3.raw

SEQ ID NO: 460762 - DNA, 512 bp, Homo sapiens
  misc_feature: HEFZJCU01DQB9J.52.1.A01.1.454.heavy.3.raw
cgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatgtccctcacctgctctgtctctggtgactccatcagcagtggttattactgggcctgggtccggcagcccccagggaaggggtttgagtggattgggagtatcgatcacagtgggagcacctacctgaacccgtccctcacgactcgagtcgccatatcaacagacacgtccaagaaccagttctacctgaggctgaactctgtgaccgccgcagacacggccgtatattattgtgcgcggggacttcgagggggtggatatagtggctacgattcgtatctccttgactacgtggggccagggaaccctggtcaccgtct

SEQ ID NO: 460763 - DNA, 511 bp, Homo sapiens
  misc_feature: HEFZJCU01C9HP0.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctggggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaggcagattcatcatctcaagagatgattccaacggcatcgcctatctgcagatgaacagcctgaagaccgaggacacagccgtctattactgtgttagggtagttttacgtatttttggt

SEQ ID NO: 460764 - DNA, 542 bp, Homo sapiens
  misc_feature: HEFZJCU01DN5N7.52.49.E05.1.454.heavy.3.raw
cgcagtacgacacgaccggtgctcgatttagagcgactagcaacacacaaaggggacccaaaaaccacacccctccttgggagaatcccctagatcacagctcctcaccatggcctggacctggagcatccttttcttggtggcagcagcaacaggtgcccactcccaggttcacctggtgcagtcgggaggtgaggttaagaggcctggggcctcagtgaaggtcgcctgcaaggcttcaggttacaccctttccacgtctggtatcagttgggtgcgacaggcccccggacaagggcttgagtggatgggatggatcagcggtgacaacggcaacacaaattatggacagaagttccagggcagagtcaccatgaccgcggacacatccacgaacacagcctacatggagctgaggagcctaagatctgacgacacggccgtttattactgtgtgagagattttagggacctcggcccttgggggagttatcgttactttgactactggggccaggggaaccctaggtccaccgtctccc

SEQ ID NO: 460765 - DNA, 497 bp, Homo sapiens
  misc_feature: HEFZJCU01BKA70.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgtttctgcaaatgaacagcctgagaattgaggactcgggtatatactactgtgcccgtgacccctgactgataaaccggactggttcgaccctgggccagggaacctggtcaccgtctcctc

SEQ ID NO: 460766 - DNA, 511 bp, Homo sapiens
  misc_feature: HEFZJCU01DCJY9.40.34.D01.1.454.heavy.3.raw
tctagcgactcacgaccggtgctcgatttagatcgtctgtgttgggtttgggggagtctccctcactgcccagctgggatctcagggcttcattttctgtcctccaccatcatgggggcaaccgccatcctcgccctcctcctggctgttgtccaaggagtctgtgccgaggtgcagctggtgcagtctggagcagaggtgaaaagcccggggagtctctgaagatctcctgtaagggttttggatacaactttaccatctactggatcgcctgggtgcgccagatgcccgggaaaggcctagagtgggtgggaatcgtctatcctgacgactctgataccagatacagcccgtccttccaaggccaggtcaccatctcagccgacaagtccgtcaataccgcctacctgcagtggagcagtctgcaggcctcggacaccgccatgtacttctgtgcgagagggttcggggatgactactggggccagggaaccctggtcaccgtctcttc

SEQ ID NO: 460767 - DNA, 386 bp, Homo sapiens; identical to SEQ ID NO: 444449
  misc_feature: HEFZJCU01CYCK5.27.46.E02.1.454.heavy.3.raw

SEQ ID NO: 460768 - DNA, 379 bp, Homo sapiens; identical to SEQ ID NO: 444450
  misc_feature: HEFZJCU01EHXTO.47.77.G11.1.454.heavy.3.raw

SEQ ID NO: 460769 - DNA, 492 bp, Homo sapiens
  misc_feature: HEFZJCU01BX3KI.13.15.B04.1.454.heavy.3.raw
tcacgtactacacgaccggtgctcgatttagacagtatatatccgcgggggccccagccctgggattcccagctgtttctgcttgctgatcaggactgcacacagagaactcaccatggagtttgggctgagcgtggtttctgtagctatttaaaggtgtccagtgtgaggtgcagctggtggagtccgggggaggcttagttcagcctggggggtccctgagactctcctgtgcagcctctggattcaccttcagtagctactggatgcactgggtccgccaagctccagggaagggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtaattctgtgcaagagagtacactattaattactatgaatgtagtgg

SEQ ID NO: 460770 - DNA, 530 bp, Homo sapiens
  misc_feature: HEFZJCU01EWVWP.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggtgaactactggggccagggcaccctggtcaccgtctcctcagcttccaccaagggcccatcggtcttcccctggcgcctgctccaggagcacctctcgggggcacgacgcggcccgtcgggccgtgccgtgggtaccaagggacctacctttccccacttaccg

SEQ ID NO: 460771 - DNA, 506 bp, Homo sapiens; identical to SEQ ID NO: 446124
  misc_feature: HEFZJCU01CZB8N.48.44.D11.1.454.heavy.3.raw

SEQ ID NO: 460772 - DNA, 531 bp, Homo sapiens
  misc_feature: HEFZJCU01BZV0S.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatgcccaggccttcacagggcggtttgtcttctccatggatacctctgtcgggacggcttatctgcagataaccaaccttcaacctgacgacactgccgttttattttgtacgagagcgtcgtctgtcagtggaattgactactggggccagggaaccctggtcaccgtctcctcagcctccaccaaggg

SEQ ID NO: 460773 - DNA, 519 bp, Homo sapiens; identical to SEQ ID NO: 449382
  misc_feature: HEFZJCU01DNYA4.16.10.A10.1.454.heavy.3.raw

SEQ ID NO: 460774 - DNA, 513 bp, Homo sapiens
  misc_feature: HEFZJCU01D7YKX.13.10.A10.1.454.heavy.3.raw
tcacgtactacacgaccggtgctcgatttagcgtcgatctcagggtcttcgtggctcacgtccaccaccacgcatgtgacctcagggagtccctgagactctcctgtgaagcctcaacattcacttttgctcgtgcctgggtgacctgggtccgccaggctccagggaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgaccctggggcccgggaaccctggtcaccgtctcctcagcctccaccaagggcccatcggtcttccccctggcaccctcctccaagagcacctctgggggcacagcggccctgggctgcctggtcaaggactactt

SEQ ID NO: 460775 - DNA, 485 bp, Homo sapiens
  misc_feature: HEFZJCU01AGYQH.52.32.C10.1.454.heavy.3.raw
cgcagtacgacacgaccggtgctcgatttagtatagacatcaacacacaaagggggggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaaggcaaggggctggagtgggtggcagttatatcatatgatggaagcaagatatactatgtagactccgtgaagggccgattcatcatctccagagacaactccgagaacacgctgtatctgcaaatgaacaggctgagagctgaagacacggctgtatattactgtgacgaacttaa

SEQ ID NO: 460776 - DNA, 535 bp, Homo sapiens
  misc_feature: HEFZJCU01EPC8A.52.53.E09.1.454.heavy.3.raw
cgcagtacgacacgaccggtgctcgatttagagagagtgtgttgggttttccttgttgctattttaaaaggtgtccagtgtggagtgcaggtggtggagtctgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttctggggccagggaacccgggtcaccgtctcctcagcctccaccaagggcccatcggtcttcccctggcaccctcctccaagagcacctctggggggcacagcggcccgtgggctgcctggtcaaggactta

SEQ ID NO: 460777 - DNA, 500 bp, Homo sapiens
  misc_feature: HEFZJCU01B0FYM.10.75.G09.1.454.heavy.3.raw
catagtagtgcacgaccggtgctcgatttagtatagacatcagggtctccctcactgcccagctgggatctcagggcttcattttctgtcctccaccatcatggggtcaaccgccatcctcgccctcctcctgactgttctccaaggtcagtcctgccgagggcttgaggtcacagaggagaacgggtggaaaggagccccggattcaaattttggttcccccccacaggagtctgtgccgaggtgcagctggtgcagtcaggagcagaggtaaagaggcccggggagtctctgaagatctcctgtaaggcctctggattcatgtttagccactcctggatcggctgggtgcgccagatgcccgggaaaggcctggagtggatggggatcatctggcctagtgactctgatatcagatacagtccgtccttccaaggccaggtcaccatctcagccgacaagtccatccagcaccgcctatctgcagtgggagtagccta

SEQ ID NO: 460778 - DNA, 518 bp, Homo sapiens
  misc_feature: HEFZJCU01BLCIG.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttattatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccaagggaccac

SEQ ID NO: 460779 - DNA, 392 bp, Homo sapiens; identical to SEQ ID NO: 444682
  misc_feature: HEFZJCU01CPVZY.16.70.G04.1.454.heavy.3.raw

SEQ ID NO: 460780 - DNA, 396 bp, Homo sapiens; identical to SEQ ID NO: 445898
  misc_feature: HEFZJCU01BBPJB.10.42.D09.1.454.heavy.3.raw

SEQ ID NO: 460781 - DNA, 524 bp, Homo sapiens; identical to SEQ ID NO: 446401
  misc_feature: HEFZJCU01BQUH9.3.82.H05.1.454.heavy.3.raw

SEQ ID NO: 460782 - DNA, 500 bp, Homo sapiens
  misc_feature: HEFZJCU01CBYWE.15.55.E11.1.454.heavy.3.raw
  modified_base (413)..(413): a, c, t, g, unknown or other
tctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtgaaaacacatattacgcaggctccgtgaagggccgcttcaccatctccagagacaattccaacaacacactttatcttcaaatgaacagcctgcgagccgaggacacggccgtatactactgtgcgagagatcgaacaggcccgtgggagcccgttgactactggggccagggaaccctggtcaccgtctcctcaacctccaccaagggcccancggtcttcccctggcaccctcctccaagagcacctctgggggcacagcggcctgggctgcctgtcaaggactacttcgctacgtaga

SEQ ID NO: 460783 - DNA, 402 bp, Homo sapiens; identical to SEQ ID NO: 444815
  misc_feature: HEFZJCU01CX0I1.11.70.G04.1.454.heavy.3.raw

SEQ ID NO: 460784 - DNA, 521 bp, Homo sapiens
  misc_feature: HEFZJCU01CANEO.4.35.D02.1.454.heavy.3.raw
agcactgtagcacgaccggtgctcgatttagcacacgatagttgggtttgggggggaaatactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtggctccatcagtaatttgtactggagctggatccggcagtcccaagggaagggactggagtgggttggatatatctttcacaccgggaccaccaactacaatccctccctcaagagtcgactcaccatgtcactggacacttccaagaaccagttctccctaaaattgacctctgtgagcgctgcagacacggccgtctattactgtgcgagactgcggggctattatggttcggggagatcccagtggttttgatatatggggccaggggacagcggtcaccgtctcttc

SEQ ID NO: 460785 - DNA, 471 bp, Homo sapiens; identical to SEQ ID NO: 448064
  misc_feature: HEFZJCU01BLQ27.14.26.C04.1.454.heavy.3.raw

SEQ ID NO: 460786 - DNA, 520 bp, Homo sapiens
  misc_feature: HEFZJCU01CWBOQ.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatacttactgtgcgagaataacccgttcgcctggttattta

SEQ ID NO: 460787 - DNA, 506 bp, Homo sapiens
  misc_feature: HEFZJCU01BSIMN.48.26.C04.1.454.heavy.3.raw
agtatacatacacgaccggtgctcgatttagtctagcgactttgggtttggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactacttcctatgtatact

SEQ ID NO: 460788 - DNA, 400 bp, Homo sapiens; identical to SEQ ID NO: 444452
  misc_feature: HEFZJCU01C4Z4J.47.24.C02.1.454.heavy.3.raw

SEQ ID NO: 460789 - DNA, 526 bp, Homo sapiens
  misc_feature: HEFZJCU01CPK0J.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacggctgtttattactgtgcgcggtggctgaccgctcttgactactgggggccggggagccccggtcatcgtct

SEQ ID NO: 460790 - DNA, 508 bp, Homo sapiens
  misc_feature: HEFZJCU01EMMGF.9.64.F09.1.454.heavy.3.raw
tgatacgtctcacgaccggtgctcgatttagcgcgtatacaaggggctcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagcctggggggtccctgagactctcctgtgcagcctctggattcacctttagtcactattggatgagttgggtccgccaggctccagggaagggcctggagtgggtggccaacataaaggaagatggaagtgagaagtcctatgtggactctgtgaagggccgattcatcatctccagagacaacgccgagaactccctgtatctgcaaatgaacagcctgagagtcgaggacacggctatgtattattgtgtgagagataaaagtggggccagggaaccctggtcaccgtct

SEQ ID NO: 460791 - DNA, 482 bp, Homo sapiens
  misc_feature: HEFZJCU01DY5K0.19.67.G01.1.454.heavy.3.raw
tactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagactttttctcagaacacacgtgtctcttcaaatgaacagcctgagggccgaggacacggccgtctattattgtgtgagagtttatggcgatggctggtggacagatcactggggccagggaaccctggtcaccgtctcctcagcctccaccaagggcccatcggtcttcccctggcgccctgctccaggagcacctccgagagcacagcggccctgggctgcctggtcaaggactacttcccacgagagta

SEQ ID NO: 460792 - DNA, 522 bp, Homo sapiens
  misc_feature: HEFZJCU01CCETX.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggttcatacatttatcctagtggtgataccatatactacgcagactctgtgagggccgattcaccatctccagggacaacgccaacgaactcactgactttgcaaatgaacaccctgcgagccgaggacacggccgtatattactgtgcgagaactaacccgttcgcctggttatttaccg

SEQ ID NO: 460793 - DNA, 523 bp, Homo sapiens; identical to SEQ ID NO: 460539
  misc_feature: HEFZJCU01CUUEH.9.78.H01.1.454.heavy.3.raw

SEQ ID NO: 460794 - DNA, 484 bp, Homo sapiens; identical to SEQ ID NO: 446564
  misc_feature: HEFZJCU01A2BU7.19.13.B02.1.454.heavy.3.raw

SEQ ID NO: 460795 - DNA, 492 bp, Homo sapiens; identical to SEQ ID NO: 446706
  misc_feature: HEFZJCU01CAKXV.11.71.G05.1.454.heavy.3.raw

SEQ ID NO: 460796 - DNA, 508 bp, Homo sapiens; identical to SEQ ID NO: 445594
  misc_feature: HEFZJCU01BM3S1.17.25.C03.1.454.heavy.3.raw

SEQ ID NO: 460797 - DNA, 519 bp, Homo sapiens
  misc_feature: HEFZJCU01D6RDA.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactcgtggtcaccgtctccgcacgcctccaccaacggcccatcc

SEQ ID NO: 460798 - DNA, 513 bp, Homo sapiens; identical to SEQ ID NO: 446452
  misc_feature: HEFZJCU01EPWFG.17.33.C11.1.454.heavy.3.raw

SEQ ID NO: 460799 - DNA, 536 bp, Homo sapiens
  misc_feature: HEFZJCU01BOL88.14.57.F02.1.454.heavy.3.raw
  modified_base (503)..(503): a, c, t, g, unknown or other
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaaggcccatcggtcttcccctggcnccctcctccaagagcacctctgggggcacagcc

SEQ ID NO: 460800 - DNA, 502 bp, Homo sapiens
  misc_feature: HEFZJCU01D9PD7.49.72.G06.1.454.heavy.3.raw
agtcgagagacacgaccggtgctcgatttagctacgactgcaagggaaagggggctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcacttatatcctatgatggaagcaataagcactacgcagagtccgtgaagggccgattgaccatctccagagacaactcgaagaatacggttcttctacaaatgaacagcctgagagctgaggacacggctatcttttactgttgcgagagggaactcgattacagcag

SEQ ID NO: 460801 - DNA, 514 bp, Homo sapiens
  misc_feature: HEFZJCU01CDWRO.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgacttactgggggccagggaactctggtcaccgtctccgcagcctccaccaggcccc

SEQ ID NO: 460802 - DNA, 481 bp, Homo sapiens
  misc_feature: HEFZJCU01BUDZU.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggtacaagtatgcacagaagtttcagggcagggtcaccatgaccagggacacgtccatcagcacgtccatcagcacagcctacatggacctgagcggcctgacatctgacgacacggccgtatatttctgtgcgagggagt

SEQ ID NO: 460803 - DNA, 482 bp, Homo sapiens; identical to SEQ ID NO: 444503
  misc_feature: HEFZJCU01BUXNK.7.10.A10.1.454.heavy.3.raw

SEQ ID NO: 460804 - DNA, 522 bp, Homo sapiens
  misc_feature: HEFZJCU01BAPZ0.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaacacagggactgcagtggattggatacatctacttcagtgggaaccccaactacaacccctccctcaggagtccagtcgccatatccctggactcgtccaacaaccagatctccctgacgatgacatctgtgaccgctgcggacacagccgtttattactgtgcgcgatctgggcgactcagtgactatggtatggacgtctggggccaagggaccacggtcatcgtctcctcacgcctccaccaagggcccatccggtccttccccctcggccaccccg

SEQ ID NO: 460805 - DNA, 527 bp, Homo sapiens
  misc_feature: HEFZJCU01C61P3.53.64.F09.1.454.heavy.3.raw
cgcgtatacacacgaccggtgctcgatttagcgcgtatacaagggggagagaggagcccagccctgggattttcaggtgttttcatgtggtgatcaggactgaacagagagaactcaccatggagtctgggctgacgtggctttttcttgtggctattttaaaaggtgtccagtgcgacgtgcagctggtggagtcggggggaggcttggtacagccgggggggtccctgagactctcctgtagagtctctggcttcacctttggagtctatgacatgagttgggtccgccaggctccggggaagggctggagtgggtctcaacgatcagtgatagcggaagtaccacaaactacgccgcctccgtgaagggccgatgcaccgtctccagagacaattcgaaggacactttatatctgcaactcaacagactgacaaccgctgacacggccgtctattactgtgtcaaagagacggaccgctggacgaggagccagaggaaaatcactactttgactactggggcca

SEQ ID NO: 460806 - DNA, 508 bp, Homo sapiens
  misc_feature: HEFZJCU01DAJKQ.51.5.A05.1.454.heavy.3.raw
cgatcgtatacacgaccggtgctcgatttagatagatagacaggggagtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagagtgagttctccctgaggctgacgtcttaagtgtcgctgatacgggtgtctatttctgtgcgagactgcccgtcctgcacctcgtgtggccccaatttcggtttaccggcacacaaaatcagggcaagtcctacgacggtct

SEQ ID NO: 460807 - DNA, 533 bp, Homo sapiens
  misc_feature: HEFZJCU01AFBDK.16.87.H10.1.454.heavy.3.raw
tgtactactccacgaccggtgctcgatttagcagtactgcgttgggtttgggggccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtaggaaacagttatgggttggggggagttggggtttttttttcgtacttacggggat

SEQ ID NO: 460808 - DNA, 504 bp, Homo sapiens
  misc_feature: HEFZJCU01AGGD6.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccgggtgagcctacggcagcggcctttgacttctc

SEQ ID NO: 460809 - DNA, 375 bp, Homo sapiens; identical to SEQ ID NO: 444442
  misc_feature: HEFZJCU01D62WQ.48.23.C01.1.454.heavy.3.raw

SEQ ID NO: 460810 - DNA, 533 bp, Homo sapiens
  misc_feature: HEFZJCU01DENLN.13.33.C11.1.454.heavy.3.raw
tcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattggggatatctcttatagtgggagtacgaactacaatccgtccctcaagagtcgagtcatcatatccgtagacaggtccaaggaacgaattctccctagaagtgagttctgtgaccgtcgcagacacggctgtactatttattgtgcgaggacggactaaatatggttcgaggggtagttcgacttacgtggggccgaacgggaaccctggtaccaccgtctcctcagcctaccacc

SEQ ID NO: 460811 - DNA, 521 bp, Homo sapiens
  misc_feature: HEFZJCU01AEBYO.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggccctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactactgggggttcgaccctggggccagggaaccctggtcacagtctcctcagcct

SEQ ID NO: 460812 - DNA, 506 bp, Homo sapiens
  misc_feature: HEFZJCU01DJDFL.52.65.F10.1.454.heavy.3.raw
cgcagtacgacacgaccggtgctcgatttagctacgctctaagggggggaggaggagcccagcactagaagtcggcggtgtttccattcggtgatcagcactgaacacagaggactcaccatggagtttaggctgagctgggttttcctcgttgctcttttaagaggtgtccagtgtcaggagcagctggtggagtctgggggaggcgtgggccagcctgggaggtccctgaaactctcctgtgcagcctctggagtcatcttcagtagttatggaatgcattgggtccgccagactccaggcagggggctggagtgggtggcagctatttcatatgatggaaataataaatattatgcagactctgtgaagggccgattcaccatctccagagacaattccaagaacagtctgtatctggaaatgaacaacctgagaggtgaggacgcggctgtgtattactgtgcgaaaagtgtattttcgattatttgagtcgggtatggacg

SEQ ID NO: 460813 - DNA, 522 bp, Homo sapiens; identical to SEQ ID NO: 457719
  misc_feature: HEFZJCU01D1VAO.4.35.D02.1.454.heavy.3.raw

SEQ ID NO: 460814 - DNA, 512 bp, Homo sapiens
  misc_feature: HEFZJCU01BBUHI.18.39.D06.1.454.heavy.3.raw
  modified_base (344)..(344): a, c, t, g, unknown or other
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagntggtcgttgtttgttttggccggtgaactactggggccagggcaccctggtcaccggtctcctcagcttccaccaagggcccatcggtcttcccctggcgccctgctccaggagcacctctgggggcacagcggccctgggctgcctggtcaaggactacttcccata

SEQ ID NO: 460815 - DNA, 518 bp, Homo sapiens
  misc_feature: HEFZJCU01EHNH4.48.34.D01.1.454.heavy.3.raw
agtatacatacacgaccggtgctcgatttagatcgtctgtgttgggtttgggatctacgttgcaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagacgcaccagcggccctcgggctcgcctggtcaaggacctacttccttacg

SEQ ID NO: 460816 - DNA, 467 bp, Homo sapiens
  misc_feature: HEFZJCU01CP1HW.16.78.H01.1.454.heavy.3.raw
tgtactactccacgaccggtgctcgatttagtgtgagtagtttgggtttgggctcaactctcctgtgcagcctctggattcaccttgagaacttatagcatgaactgggtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcgggggactacctcgacccctggggccaaggaatactggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 460817 - DNA, 489 bp, Homo sapiens
  misc_feature: HEFZJCU01EDCWE.18.70.G04.1.454.heavy.3.raw
  modified_base (413)..(413): a, c, t, g, unknown or other
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaaggccatcggtcttcccctggcnccctgctccaggagcacctccgagagcacagccggccctgggctgcctggtcaaggactacttcccatacctcgta

SEQ ID NO: 460818 - DNA, 511 bp, Homo sapiens
  misc_feature: HEFZJCU01DVJ9G.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgccctgctccaggagcacctctgggggcacagcggccctgggctgcctggtcaaggactacttccatac

SEQ ID NO: 460819 - DNA, 469 bp, Homo sapiens; identical to SEQ ID NO: 452463
  misc_feature: HEFZJCU01EOMZB.4.36.D03.1.454.heavy.3.raw

SEQ ID NO: 460820 - DNA, 482 bp, Homo sapiens; identical to SEQ ID NO: 444503
  misc_feature: HEFZJCU01BSQB5.7.10.A10.1.454.heavy.3.raw

SEQ ID NO: 460821 - DNA, 521 bp, Homo sapiens
  misc_feature: HEFZJCU01BW165.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagtttgggctgagctggattttccttgctgctattttaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctggggccgggaaccctggtcaccgtctccccaccct

SEQ ID NO: 460822 - DNA, 527 bp, Homo sapiens
  misc_feature: HEFZJCU01D5TKO.22.11.A11.1.454.heavy.3.raw
acatacgcgtcacgaccggtgctcgatttagctacgactgcagggtgtacacctgtggttctcgggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccagggaaggggctggagtggatctcagttatttatctcggtggtaacacatactacgcagactccgtggagggccgattcaccatctccagagacaattccaagaacacggtgtatcttcaaatgaacagcctgagagccgatgacacggccgtgtattactgtgtgagatcaaatttccaagccgcgggggtcacccaaattgactactgggccgagggaaccctggtcaccgtctcctcagcctccaccaagggcccatccggtcttccccctcggcgccctcgctccac

SEQ ID NO: 460823 - DNA, 378 bp, Homo sapiens
  misc_feature: HEFZJCU01CGX8G.47.77.G11.1.454.heavy.3.raw
agctcacgtacacgaccggtgctcgatttagctagtcactcaagggaaaggggttggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctggggcacagcggccctgggctgcctggtcaaggactacttcctacgtgagct

SEQ ID NO: 460824 - DNA, 531 bp, Homo sapiens
  misc_feature: HEFZJCU01DCFL2.52.5.A05.1.454.heavy.3.raw
cgcagtacgacacgaccggtgctcgatttagatagatagacagggggctctgggaaaggagccccagccctgagattcccaggtgtttccattcggtgatcagcactgaacacagaactcaccatggagtttggactgagctgggttttccttgttgctattttaaaaggtgtccaggctgaagtgcagctggtggaatctgggggaatcgtggtgcggcctggggggtccctgagactctcctgttcagccgctggattcacgttttgatgattatgccatgtactgggtccgtcaagctccggggaagggtctggagtgggtctctcttgtgaattgggatggcagtgcttcttattacgccgactctgtgaagggtcggttcaccatctccagagacaacagaaaaactccctatatcttcaaatgagaagtctgagaattgaggacaccgccttatattactgcgctaaaggccttgacgcgttggctataaatggattgggaccacgtggggccgaggggaaccca

SEQ ID NO: 460825 - DNA, 527 bp, Homo sapiens
  misc_feature: HEFZJCU01B4LIN.53.10.A10.1.454.heavy.3.raw
cgcgtatacacacgaccggtgctcgatttagcgtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgccctccaggggggacctttgggggtttcgaccccgtggggccagggaaccctggtcaccgtctcctcagcctccaccaagggcccatcggtcttcccctggcaccctcctccaagagcacctctgggggcacagcc

SEQ ID NO: 460826 - DNA, 501 bp, Homo sapiens
  misc_feature: HEFZJCU01AVDFS.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacgggacacccccacgaacacagtctacatgcaactgacgagcctgagagctgacgacacggccgtctattactgtgcgagaatgttttctgtcatcgtacaatttgataggctctatggactggacttct

SEQ ID NO: 460827 - DNA, 395 bp, Homo sapiens; identical to SEQ ID NO: 444494
  misc_feature: HEFZJCU01EUPLJ.47.46.E02.1.454.heavy.3.raw

SEQ ID NO: 460828 - DNA, 515 bp, Homo sapiens
  misc_feature: HEFZJCU01EIJPZ.49.68.G02.1.454.heavy.3.raw
agtcgagagacacgaccggtgctcgatttagtcgatagtgaagggaaagggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcctagttcagcctggggggtccctgagactctcctgtgcagcctctggattcaccttcagtagctactggatggactgggtccgccaagctccagggaaggggctggtgtgggtctcacgtattaatagtgatgggagtagaaaaagctacgcggactccgtgaagggccgattctccatctccagagacaacgccaagaacacgctgtatctgcaaatgaacagtctgagagccgaggaaacggctgtgtattactgtgcaggtatcgaccgcgacacaaaattcgagatacacgcccagtgactactc

SEQ ID NO: 460829 - DNA, 510 bp, Homo sapiens
  misc_feature: HEFZJCU01C0N0D.10.28.C06.1.454.heavy.3.raw
catagtagtgcacgaccggtgctcgatttagagctcacgtattgggtttggaggcttggtacagcctggggggtccctgagactctcctgtgtagcgtctggattcacattcagtagttatagcatgaactgggtccgccaggctccagggaaggggctggagtgggtttcatatattgatagaaatagtggaaccatatactatgcagactctgtgaggggccgattcaccatctccagagacaatgccaggaattcactgtatgtggaaatgaacagtctgagagccgaggacacggctctctattactgtgcgagagccccgaaaatagggtctacgattactcattctgactactggggccagggaaccctggtcaccgtctcctcagcctccaccaaggcccatcggtcttcccctcggcgccctcgctccaggagcacctccgagagcacagcggcccgtgggctcgcctggtcgaaggactacttccctactactatgctgac

SEQ ID NO: 460830 - DNA, 522 bp, Homo sapiens
  misc_feature: HEFZJCU01EUXDO.49.59.F04.1.454.heavy.3.raw
agtcgagagacacgaccggtgctcgatttagtacacacacttagggattggggcagctacaggtgtccagtcccaggtccagctggtgcaatctggggctgaggtgaagaagcctgggtcctcggtgaaggtctcctgtaaggcttctggaggcaccctcagcagttatactatgaattgggtgcgacaggcccctggacaagggcttgagtggatggggaggatcatccctattgttggtgtgacaaactacgcacagaagttccaggacagaatcacgataaccgcggacacatccacgagcactattttcatggaactgagcagcctcagatccgaggacacggccgtttactactgtgcgagcgatcccggattcccgcgtttcgaggatgactactggggccagggaaccctggtcaccgtctcctcagcctccaccaagggcccatcggtcttccccctggcaccctcctccaagagcacctctgggggcacagcggccctgggctgcctggtcaa

SEQ ID NO: 460831 - DNA, 511 bp, Homo sapiens
  misc_feature: HEFZJCU01AGDRF.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccgacacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgccctgctccaggagcacctctgggggcacagcggccctgggctgcctggtcaggactacttcccatac

SEQ ID NO: 460832 - DNA, 501 bp, Homo sapiens; identical to SEQ ID NO: 447719
  misc_feature: HEFZJCU01DX6RA.17.10.A10.1.454.heavy.3.raw

SEQ ID NO: 460833 - DNA, 490 bp, Homo sapiens; identical to SEQ ID NO: 449137
  misc_feature: HEFZJCU01CWCBZ.11.26.C04.1.454.heavy.3.raw

SEQ ID NO: 460834 - DNA, 490 bp, Homo sapiens
  misc_feature: HEFZJCU01EJ61M.4.53.E09.1.454.heavy.3.raw
  modified_base (485)..(485): a, c, t, g, unknown or other
agcactgtagcacgaccggtgctcgatttagagagagtgtgttgggtttggggggtccctgagactctcctgtacagtctctgcatctaccttcacttctttttggatgacctggctccgccgggctccagggagggggctggagtgggtggccaccatcaatcaagatggaagtgagagaacctatgtggactctgtgaagggccgattcaccatctccagagacaacgccaagaattctctgtatctgcaaatgaacagcctgagagccgaggactcggctgtctattactgtgcgaggaagaagtattactatgatacaagtgacatgggctggttcgaccctggggccagggaaccctggtccaccgtctcctcacgcctccaccaagggcccatcggtcttcccctggcgccctgctccaggagcacctccgagagcacagccggccctgggctgcctggtcaaggactacttccctacngtgct

SEQ ID NO: 460835 - DNA, 379 bp, Homo sapiens; identical to SEQ ID NO: 446571
  misc_feature: HEFZJCU01EHT3Z.3.59.F04.1.454.heavy.3.raw

SEQ ID NO: 460836 - DNA, 501 bp, Homo sapiens
  misc_feature: HEFZJCU01EOVTG.4.58.F03.1.454.heavy.3.raw
agcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaaagccttgagtggatgggatcgatcaactctggcaatggcaacacaaaatattcacagaagttacagggcagagtcaccattaccagggacacatccgcgaacacagcctacatggagctgagcagcctgacatctgaagacacggctgtgtattactgttcgagacgggctagtctgggatctagttatagtgactgtcgttctggggccg

SEQ ID NO: 460837 - DNA, 516 bp, Homo sapiens
  misc_feature: HEFZJCU01B88GH.52.75.G09.1.454.heavy.3.raw
cgcagtacgacacgaccggtgctcgatttagtatagacatcaggggagctctgagagaggagcccagccctgggattttcaggtgttttcatttggtgatcaggactgaacagagagaactcaccatggagtttgggctgagctggctttttcttgtggctattttaaaaggtgtccatggtgaggtgcggctgttggaatccgggggggcttgatacagcctggggggtccctgagactctcctgtgctgcctctggattcagtttcagtgacttagccatgagctgggtccgccaggctccagggaaggggctggaatgggtctcagtcgttactgctggacttactaccacatactacgcagactccgtgaagggccggttcgccatctccagagacaattccaagaataccctatatctgcaaatgagcagcctgagagccgaggacacggcgtatattactgtgcgatgggaagtagtggttactactactactttgacaactggggaccg

SEQ ID NO: 460838 - DNA, 379 bp, Homo sapiens; identical to SEQ ID NO: 444450
  misc_feature: HEFZJCU01AXD0O.47.77.G11.1.454.heavy.3.raw

SEQ ID NO: 460839 - DNA, 511 bp, Homo sapiens
  misc_feature: HEFZJCU01DX2LP.51.28.C06.1.454.heavy.3.raw
  modified_base (508)..(508): a, c, t, g, unknown or other
cgatcgtatacacgaccggtgctcgatttagagctcacgtattgggtttgggctgagctgggttttcctcgttgctctttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtctggggccaagggaccacggtcaccgtctctagcctcacaggccatcgtctccctgcacctctccaanagc

SEQ ID NO: 460840 - DNA, 505 bp, Homo sapiens; identical to SEQ ID NO: 445474
  misc_feature: HEFZJCU01BZIXX.16.34.D01.1.454.heavy.3.raw

SEQ ID NO: 460841 - DNA, 483 bp, Homo sapiens; identical to SEQ ID NO: 444639
  misc_feature: HEFZJCU01DQMGF.11.23.C01.1.454.heavy.3.raw

SEQ ID NO: 460842 - DNA, 505 bp, Homo sapiens
  misc_feature: HEFZJCU01CC25G.47.55.E11.1.454.heavy.3.raw
agctcacgtacacgaccggtgctcgatttagcactcgcacgttgggttgggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttaggttcagcctggggagtccctgagactctcctgtgtagtctctggaatcagtttcagtaccttctggatgcactggtctgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctggtctatcattgtgttttcgatgccttggtccgcgggtacttcgtggggccac

SEQ ID NO: 460843 - DNA, 501 bp, Homo sapiens; identical to SEQ ID NO: 447719
  misc_feature: HEFZJCU01BCKJ7.17.10.A10.1.454.heavy.3.raw

SEQ ID NO: 460844 - DNA, 535 bp, Homo sapiens
  misc_feature: HEFZJCU01B12CD.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaacgggccc

SEQ ID NO: 460845 - DNA, 513 bp, Homo sapiens
  misc_feature: HEFZJCU01B1YZC.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccagaacgttactacgctatggacgtctggggccg

SEQ ID NO: 460846 - DNA, 399 bp, Homo sapiens
  misc_feature: HEFZJCU01CC059.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccggggagagcacctccgagagcacagcggccctgggctgcctggtcaaggactacttcctacgtgagct

SEQ ID NO: 460847 - DNA, 482 bp, Homo sapiens; identical to SEQ ID NO: 444503
  misc_feature: HEFZJCU01C135G.7.10.A10.1.454.heavy.3.raw

SEQ ID NO: 460848 - DNA, 503 bp, Homo sapiens; identical to SEQ ID NO: 445995
  misc_feature: HEFZJCU01AQJKJ.17.25.C03.1.454.heavy.3.raw

SEQ ID NO: 460849 - DNA, 512 bp, Homo sapiens
  misc_feature: HEFZJCU01B7Z91.48.27.C05.1.454.heavy.3.raw
agtatacatacacgaccggtgctcgatttagacgcgatcgaagggtttggggtttgggtgctgggcacggtgggcatgtgtgagttttgtcacaagatttgggctcaactctcctgtgcagcctctggattcacctttgatgattatgccatgcactgggtccggcaagttccagggaagggcctggagtgggtctcaggcattagtagaattaggggtagcatagcctatgcggattctgtgaagggccgattcaccatctccagagacaacgccaagaactccctgtatctgcaaatgaacagtctgagacctgaggacacggccttctattactgtgcaaaagatcaggcattagactacaacggtatggacgtctggggccaagggatcacggtcaccgtctcctcagcctccaccaagggcccatcggtcttccccctggcaccctcctccaagagcacctctgggggcacagcggccctgggctgcctggtcaaggactacttcct

SEQ ID NO: 460850 - DNA, 523 bp, Homo sapiens; identical to SEQ ID NO: 446270
  misc_feature: HEFZJCU01BCCG7.12.40.D07.1.454.heavy.3.raw

SEQ ID NO: 460851 - DNA, 519 bp, Homo sapiens
  misc_feature: HEFZJCU01CVMTU.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccaagggacccg

SEQ ID NO: 460852 - DNA, 490 bp, Homo sapiens; identical to SEQ ID NO: 449137
  misc_feature: HEFZJCU01B8PMJ.11.26.C04.1.454.heavy.3.raw

SEQ ID NO: 460853 - DNA, 521 bp, Homo sapiens
  misc_feature: HEFZJCU01B6388.12.40.D07.1.454.heavy.3.raw
atacgacgtacacgaccggtgctcgatttagtgatagagcgtaacaacaggggactcaccatggagtttgggctgagctgggtttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctcccagcctccaccaaggcccatcggtctcccctggcgcctg

SEQ ID NO: 460854 - DNA, 507 bp, Homo sapiens; identical to SEQ ID NO: 453381
  misc_feature: HEFZJCU01EMUU5.51.13.B02.1.454.heavy.3.raw

SEQ ID NO: 460855 - DNA, 531 bp, Homo sapiens
  misc_feature: HEFZJCU01C1E0Z.13.33.C11.1.454.heavy.3.raw
tcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacggacaaatatggttcaggggagtttcgactacgtggggccagggaaccctggtcaccggtctcctcacgccctccaccgaacgggg

SEQ ID NO: 460856 - DNA, 510 bp, Homo sapiens; identical to SEQ ID NO: 460732
  misc_feature: HEFZJCU01CNYA7.8.34.D01.1.454.heavy.3.raw

SEQ ID NO: 460857 - DNA, 528 bp, Homo sapiens
  misc_feature: HEFZJCU01C6IIL.52.5.A05.1.454.heavy.3.raw
cgcagtacgacacgaccggtgctcgatttagatagatagacagggggctctgggaaaggagccccagccctgagattcccaggtgtttccattcggtgatcagcactgaacacagaactcaccatggagtttggactgagctgggttttccttgttgctattttaaaaggtgtccaggctgaagtgcagctggtggaatctgggggaatcgtggtgcggcctggggggtccctgagactctcctgttcagccgctggattcacgtttgatgattatgccatgtactgggtccgtcaagctccggggaagggtctggagtgggtctctcttgtgaattgggatggcagtgcttcttattacgccgactctgtgaagggtcggttcaccatctccagagacaacagaaaaaactccctatatcttcaaatgagaagtctgagaattgaggacaccgccttatattactgcgctaaaggccttgacgcgttggctataaatggattggaccactggggccagggaacccac

SEQ ID NO: 460858 - DNA, 512 bp, Homo sapiens
  misc_feature: HEFZJCU01BBQF6.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtgcgttttcttaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaagggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgaactactggggccg

SEQ ID NO: 460859 - DNA, 504 bp, Homo sapiens; identical to SEQ ID NO: 454912
  misc_feature: HEFZJCU01AEX60.17.25.C03.1.454.heavy.3.raw

SEQ ID NO: 460860 - DNA, 490 bp, Homo sapiens; identical to SEQ ID NO: 449137
  misc_feature: HEFZJCU01DQSQI.11.26.C04.1.454.heavy.3.raw

SEQ ID NO: 460861 - DNA, 501 bp, Homo sapiens
  misc_feature: HEFZJCU01EM39Q.9.33.C11.1.454.heavy.3.raw
tgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcggtcttcccctggcgccctgctccaggagcacctccgagagcacagcgccctgggctgcctgtcaaggactacttccagacgtatca

SEQ ID NO: 460862 - DNA, 503 bp, Homo sapiens
  misc_feature: HEFZJCU01B1GI4.4.57.F02.1.454.heavy.3.raw
agcactgtagcacgaccggtgctcgattagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttccccctgcgccctgctccaggagcacctctgggggc

SEQ ID NO: 460863 - DNA, 481 bp, Homo sapiens; identical to SEQ ID NO: 445517
  misc_feature: HEFZJCU01BQKP5.22.36.D03.1.454.heavy.3.raw

SEQ ID NO: 460864 - DNA, 491 bp, Homo sapiens
  misc_feature: HEFZJCU01B8UE2.49.82.H05.1.454.heavy.3.raw
agtcgagagacacgaccggtgctcgatttagtcgagctctctcgcggggtctcagagaggtgccttagccctggattccaaggcatttccacttggtgatcagcactgaacacagaggactcaccatggaattggggctgtgctgggttttccttgttgctattttagaaggtgtccactgtgacgtgcagctggtggagtctggggggagccttggttcagcctggagggtccctgagactctcctgtgcagcctctggattcagcttcagtagttatgagatgaactgggtccgccaggctccagggaagggactggagtgggtttcatacattagtcggagagtcaacaccgtattctacacagactctgtgaggggccgattcaccatctccagagacaacgccaagaactcactgtatctccaaatgaacagcctgagagtcgaggacacggctgtctattactgtgcgagagatcccaacagcgg

SEQ ID NO: 460865 - DNA, 399 bp, Homo sapiens; identical to SEQ ID NO: 451078
  misc_feature: HEFZJCU01CXDKF.47.24.C02.1.454.heavy.3.raw

SEQ ID NO: 460866 - DNA, 498 bp, Homo sapiens; identical to SEQ ID NO: 445952
  misc_feature: HEFZJCU01C1LYX.11.71.G05.1.454.heavy.3.raw

SEQ ID NO: 460867 - DNA, 539 bp, Homo sapiens
  misc_feature: HEFZJCU01E2AP7.2.81.H04.1.454.heavy.3.raw
acgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctggtggagtccgggggaggctgggtccagcctggggggtccctgagactctcctgttcagcctctggattcacctttagtaggttttggatgagttgggtccgccaggctccagggaaggggctggagtgggtggccaacatagagtacgatggaagtgagaaaaactatgtggactccgtgaagggccgattcaccatctccagagacaacgacaagaatttaagtgtattctgcgaaatagagcagcctacgagaggccgacgggacgaccggacgtcgtgtagttattgtgtcgaggt

SEQ ID NO: 460868 - DNA, 437 bp, Homo sapiens; identical to SEQ ID NO: 447018
  misc_feature: HEFZJCU01C8DW3.40.27.C05.1.454.heavy.3.raw

SEQ ID NO: 460869 - DNA, 488 bp, Homo sapiens
  misc_feature: HEFZJCU01ERUCJ.18.70.G04.1.454.heavy.3.raw
tacgagtatgcacgaccggtgctcgatttagtgtagtgtgaagggaaagggggaagaggacgactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgccctgctccaggagcacctccgagagcacagcggccctgggctgcctggtcaggactacttcccatactcgta

SEQ ID NO: 460870 - DNA, 523 bp, Homo sapiens
  misc_feature: HEFZJCU01BEFOP.3.17.B06.1.454.heavy.3.raw
  modified_base (429)..(429): a, c, t, g, unknown or other
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttancttgcaaatgaacagccctggagaacccgacgacacggcccgtctattattgtgtcatagacctaggatacaacgacggtggtacctggtattc

SEQ ID NO: 460871 - DNA, 381 bp, Homo sapiens; identical to SEQ ID NO: 445431
  misc_feature: HEFZJCU01CPHJ6.3.70.G04.1.454.heavy.3.raw

SEQ ID NO: 460872 - DNA, 503 bp, Homo sapiens
  misc_feature: HEFZJCU01DLPS7.10.28.C06.1.454.heavy.3.raw
catagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtggagtcggggggaggcttggtacagcctggggggtccctgagactctcctgtgtagcgtctggattcacattcagtagttatagcatgaactgggtccgccaggctccagggaaggggctggagtgggtttcatatattgatagaaatagtggaaccatatactatgcagactctgtgaggggccgattcaccatctccagagacaatgccaggaattcactgtatgtggaaatgaacagtctgagagccgagaacacggctctctattactgtgcgagagcccgaaaatagggtctacg

SEQ ID NO: 460873 - DNA, 522 bp, Homo sapiens; identical to SEQ ID NO: 446788
  misc_feature: HEFZJCU01EKWU6.12.40.D07.1.454.heavy.3.raw

SEQ ID NO: 460874 - DNA, 524 bp, Homo sapiens
  misc_feature: HEFZJCU01BEZHM.12.40.D07.1.454.heavy.3.raw
atacgacgtacacgaccggtgctcgatttagtgatagagcgtaacaacagagggctcaccatggagtttgggctgagcgtgggttttcgtcgttaggctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagaccggacacggctgtctattattgcgcgagagagacacacgaacctactggccaatctatgggggcttgttctggggcaggggacctggtcatcgtctcccagcctccaccgaaggcccatcggtcttccccctggccg

SEQ ID NO: 460875 - DNA, 316 bp, Homo sapiens
  misc_feature: HEFZJCU01BKD3Q.13.66.F11.1.454.heavy.3.raw
tcacgtactacacgaccggtgctcgatttagtcacgcgagaagggcagattcaccatctccagagatgattcaaggaacacagtgtttctgcaaatgaacagcctgactgccggggacactgccgtgtattactgtgccagcagcagtacctggccactatattttttgacttctggggccagggaaccctggccaccgtctcctcagcttccaccaagggcccatcggtcttcccctggcgccctgctccaggagcacctctgggggcacagcggccctgggctgcctggtcaaggactacttccgtactagacg

SEQ ID NO: 460876 - DNA, 525 bp, Homo sapiens
  misc_feature: HEFZJCU01A8W5P.3.56.F01.1.454.heavy.3.raw
agacgcactccacgaccggtgctcgatttagcagacgtctgaacacacaaagggggctctccaccatggacatactctgttccacgctcctgctactgactgccccgtcctgggtcttatcccaggtcaccttgagggagtctggtcctgcgctggtgaaacccacagagaccctcaccctgacgtgcaccttctctggcttctcactcagttccagtggaatgtgtgtgagctggatccgtcagcccccagggaaggccccggagtggcttgcactcattgatgggaatgatgataaatacttcagcaaatctctggagaccaggctcaccatctccaaggacacctccaaaaaccaggtagtccttataatgaccaacatggaccctgtggacacagccacgtattactgtgcccggacccccgcacccgctcggggtattccaccccaattccactacaaaatggacgtctgggcaaagggaccacggtcatcgtctcctcagcctccaccaagggcccacg

SEQ ID NO: 460877 - DNA, 478 bp, Homo sapiens; identical to SEQ ID NO: 448105
  misc_feature: HEFZJCU01ESWWI.26.78.H01.1.454.heavy.3.raw

SEQ ID NO: 460878 - DNA, 371 bp, Homo sapiens; identical to SEQ ID NO: 444919
  misc_feature: HEFZJCU01C7TUO.3.1.A01.1.454.heavy.3.raw

SEQ ID NO: 460879 - DNA, 484 bp, Homo sapiens; identical to SEQ ID NO: 445876
  misc_feature: HEFZJCU01DH7UK.8.39.D06.1.454.heavy.3.raw

SEQ ID NO: 460880 - DNA, 385 bp, Homo sapiens; identical to SEQ ID NO: 444438
  misc_feature: HEFZJCU01AQM8K.18.60.F05.1.454.heavy.3.raw

SEQ ID NO: 460881 - DNA, 514 bp, Homo sapiens
  misc_feature: HEFZJCU01AOSHV.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccgagggaaggggctggaatgggtctcaggtattactggtggtggttataccacatactacgcagactccgtgaagggccggttcaccatctcagagacaattccaagaacacactgtatctgcaaatgaacagcctgagagccgacgaccacggccatatattactgtgcgaaagcaccggcagttagtcacccatacctactttgactacgtggggaccg

SEQ ID NO: 460882 - DNA, 388 bp, Homo sapiens
  misc_feature: HEFZJCU01DMNMN.52.34.D01.1.454.heavy.3.raw
cgcagtacgacacgaccggtgctcgatttagatcgtctgtgctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttccccctggcaccctcctccaagagcacctctgggggcacagcggccctgggctgcctggtcaaggactacttcctatacgatcg

SEQ ID NO: 460883 - DNA, 498 bp, Homo sapiens
  misc_feature: HEFZJCU01CDXKT.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttccccctggcgccctgctccacggagcacctccgagagcacagcggcctgggctgcctggtcaaggacttacg

SEQ ID NO: 460884 - DNA, 415 bp, Homo sapiens
  misc_feature: HEFZJCU01DJ4MH.14.74.G08.1.454.heavy.3.raw
cgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaatggtcaccgtctcttcagcctccaccaagggcccatcggtcttccccctggcacctcctccaagagcacctctgggggcacagcggccctgggctgcctggtcaaggactacttccgtactagacg

SEQ ID NO: 460885 - DNA, 519 bp, Homo sapiens
  misc_feature: HEFZJCU01CWUR0.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttctcaaatgaacagcctgagagccgatgacacggccgtgtattactgtgcgagagagtggggcccacgaacgttactacgctatggacgtctggggccaagggaccg

SEQ ID NO: 460886 - DNA, 482 bp, Homo sapiens; identical to SEQ ID NO: 444904
  misc_feature: HEFZJCU01BQZI6.47.59.F04.1.454.heavy.3.raw

SEQ ID NO: 460887 - DNA, 519 bp, Homo sapiens; identical to SEQ ID NO: 456175
  misc_feature: HEFZJCU01CLQDR.2.81.H04.1.454.heavy.3.raw

SEQ ID NO: 460888 - DNA, 489 bp, Homo sapiens
  misc_feature: HEFZJCU01C3JJ9.48.20.B09.1.454.heavy.3.raw
agtatacatacacgaccggtgctcgatttagtgtagtgtgaagggggagcacaattgaaaaagcccggggagtctctgaagatctcctgtgagggttctggatacagctttgccaactactggatcgcctgggtgcgccagatgcccgggaaaggcctggagtggatggggatcatctatcctggcgactctgataccagatacagcccgtccttccaaggccaagtcaccatctcagccgacaactccatcagcaccgcctacctgcagtggagcagcctgaaggcctcggacaccgccgtgtattactgtgcgagacatgattacggctactcacgtccgcactactggggccagggaaccctggtcaccgtctcctcagcttccaccaagggcccatcggtcttcccctggcgccctgctccaggagcacctctgggggcacagcggccctgggctgcctggtcaggactacttcctatgtatact

SEQ ID NO: 460889 - DNA, 498 bp, Homo sapiens
  misc_feature: HEFZJCU01AL9ZJ.51.23.C01.1.454.heavy.3.raw
cgatcgtatacacgaccggtgctcgatttagtacacgtgattagggattgggggagactgagtgtgagtgaacatgagtgagaaaactggatttgtgtggcagtttctgaaaacggtgtccttctgtttgcaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaacttgaagaatacggttcttctacaaatgaacagcctgagagctgaggacacggctatgttttactgtgcgagagggaactcgattacagcagccctcgaagacatcatgatggctttgatatcgtggggaccg

SEQ ID NO: 460890 - DNA, 502 bp, Homo sapiens
  misc_feature: HEFZJCU01CND33.51.78.H01.1.454.heavy.3.raw
cgatcgtatacacgaccggtgctcgatttagtgtgagtagtttgggtttgggggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtccttccccctcggccaccctcctccaacgagcacctctgggggcacagcggccctgggctgcctggtcaaggactacttcctcgtagcact

SEQ ID NO: 460891 - DNA, 464 bp, Homo sapiens
  misc_feature: HEFZJCU01DE065.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacggggggaaaattggggccagggaaccctggtctccgtctcgtcagcctccaccaagggcccatcggtcttcccctggcgccctgcctccaggagcacctccgagagcacagcggccctgggctgcctggtcaaggactactcccacgagagta

SEQ ID NO: 460892 - DNA, 515 bp, Homo sapiens
  misc_feature: HEFZJCU01BC7DU.17.33.C11.1.454.heavy.3.raw
  modified_base (498)..(498): a, c, t, g, unknown or other
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctactggttcggggagttattagtccctactttgactactggggccaggggaactctggtcaccgtctccgcngcctccaccaagggccc

SEQ ID NO: 460893 - DNA, 495 bp, Homo sapiens
  misc_feature: HEFZJCU01EYWIL.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctgggccgtggcaccctgctgactgtctcctcagcctccaccaagggcccatcggtcttccccctggcgccctgctccaggagcacctccgagagcacagcggcctgggctgcctggtcaaggactac

SEQ ID NO: 460894 - DNA, 411 bp, Homo sapiens; identical to SEQ ID NO: 445580
  misc_feature: HEFZJCU01A50DA.51.31.C09.1.454.heavy.3.raw

SEQ ID NO: 460895 - DNA, 400 bp, Homo sapiens
  misc_feature: HEFZJCU01D9UNF.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagagggacacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 460896 - DNA, 390 bp, Homo sapiens; identical to SEQ ID NO: 444654
  misc_feature: HEFZJCU01C0153.16.17.B06.1.454.heavy.3.raw

SEQ ID NO: 460897 - DNA, 534 bp, Homo sapiens
  misc_feature: HEFZJCU01EDPJV.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccaattggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaagtaatggctgtgtttattggggccagggagcctggtctaccg

SEQ ID NO: 460898 - DNA, 403 bp, Homo sapiens; identical to SEQ ID NO: 445029
  misc_feature: HEFZJCU01DPFEU.10.77.G11.1.454.heavy.3.raw

SEQ ID NO: 460899 - DNA, 505 bp, Homo sapiens
  misc_feature: HEFZJCU01A0GR8.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccattcaccatctccagagacaattccaagaacacgctgtttcttcaaatgaacagcctgagagccgatgacacggccgtgtattactgtgcgagagagtggggcccacgaacgttactacgctatggacgtc

SEQ ID NO: 460900 - DNA, 506 bp, Homo sapiens
  misc_feature: HEFZJCU01EH67F.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttcgtggggccagggaa

SEQ ID NO: 460901 - DNA, 505 bp, Homo sapiens
  misc_feature: HEFZJCU01A4OJ9.48.44.D11.1.454.heavy.3.raw
agtatacatacacgaccggtgctcgatttagcgcagtacgaggggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggcctgggctgcctggtcaaggactacttcctatgtatact

SEQ ID NO: 460902 - DNA, 493 bp, Homo sapiens
  misc_feature: HEFZJCU01E0MRX.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttccccctggcaccctcctcccaagagcacctctgggggcacagcggccctgggctgcctggtcaaggactacttccgagtgcgtct

SEQ ID NO: 460903 - DNA, 491 bp, Homo sapiens; identical to SEQ ID NO: 444592
  misc_feature: HEFZJCU01EYI24.11.26.C04.1.454.heavy.3.raw

SEQ ID NO: 460904 - DNA, 513 bp, Homo sapiens
  misc_feature: HEFZJCU01BWLYZ.10.59.F04.1.454.heavy.3.raw
catagtagtgcacgaccggtgctcgatttagtacacacacttagggattgggggctttctgagagtcatggacctcctgtgcaagaacatgaatcacctgtggttcttcctcctgctggtggcggcccccagatgggtcctgtcccagctgcagctgcatgagtcgggcccaggactggtgaggccttcggataccctgtccctcagttgcgctgtctctggtggctccatcaacagtggtgacaactggtggggctgggtccgccagcccccagggatgggactggagtggattggccttacacattatagtgggactacccactacaacccgtccctcaggagtcgagtcaccatctcactagacacgtccaggaatcacctctccctgacggtgacctctgtgaccgccgcggacacggccgtgtattattgtgcgagagaccccgctgaagattcctcaatgtactttgaccactggggccagggagccctggtcaccgtctcctcacg

SEQ ID NO: 460905 - DNA, 512 bp, Homo sapiens
  misc_feature: HEFZJCU01BFL2O.51.78.H01.1.454.heavy.3.raw
  modified_base (492)..(492): a, c, t, g, unknown or other
  modified_base (508)..(508): a, c, t, g, unknown or other
cgatcgtatacacgaccggtgctcgatttagtgtgagtagtttgggtttgggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttcccctggcaccctcctccaagagcacctctgggggcacagcggccctgggctgcctggtcaaggactactccgtgcgacnctcgtagcggcgtcgngacg

SEQ ID NO: 460906 - DNA, 519 bp, Homo sapiens
  misc_feature: HEFZJCU01CPRG1.4.28.C06.1.454.heavy.3.raw
  modified_base (427)..(427): a, c, t, g, unknown or other
agcactgtagcacgaccggtgctcgatttagagctcacgtattgggtttgggggccccagccctgggattcccagctgtttctgcttgctgatcaggactgcacacagagaactcaccatggaatttgggctgagctgggtttttccttgttgctattttaaaaggtgtccagtgtgaggtgctcctggtggagtccgggggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgaggggccgattcaccatcttcagagacaacgccaaggacacgctgtatctggaaatgancagtctgagagccgaggacacggctgtgtattactgtgcaagagataacggacttggtacgccctttgactacgtgggggccccggggacct

SEQ ID NO: 460907 - DNA, 506 bp, Homo sapiens
  misc_feature: HEFZJCU01C6D6W.52.34.D01.1.454.heavy.3.raw
cgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttcccctggcaccctcctccaagagcacctctgggggcacagcggccctgggctgcctgatcaaggactacttcctatacgatcg

SEQ ID NO: 460908 - DNA, 482 bp, Homo sapiens
  misc_feature: HEFZJCU01ATCV1.49.78.H01.1.454.heavy.3.raw
agtcgagagacacgaccggtgctcgatttagtgtgagtagtttgggtttggggctgggagaggagcccagcactagaagtcggcggtgcttccattcggtgatcagcactgaacacagaggactcaccatggagtttgggctgagcggtggtttcgtcgtaggcgtctttaagtaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagacacgctgtatctgcaaatgaacaggctgagagctgaagacacggctgtatattactgtgcgaactt

SEQ ID NO: 460909 - DNA, 541 bp, Homo sapiens
  misc_feature: HEFZJCU01C176Y.52.15.B04.1.454.heavy.3.raw
cgcagtacgacacgaccggtgctcgatttagacagtatatatccgcgggcacgaccggtgctcgatttagtagcatactgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttcccctggcaccctcctccaagagcacctctgggggcacagcggccctgggctgcctggtcaaggactacttcctatacg

SEQ ID NO: 460910 - DNA, 494 bp, Homo sapiens
  misc_feature: HEFZJCU01D7A6R.11.13.B02.1.454.heavy.3.raw
  modified_base (465)..(465): a, c, t, g, unknown or other
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtggagtccctggctggcacctgtatccgaccgttggagtcagggaactctggtcaccgtctcctcagcctccaccaagggcccatcggtcttcccctggcgccctgctccaggagcacctccgagagcacagcggccctgggtcccccgntcggtcaaggactacttccgtatctctcg

SEQ ID NO: 460911 - DNA, 508 bp, Homo sapiens
  misc_feature: HEFZJCU01B3EE6.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaaactcctactacggtctggacgtctgtggcc

SEQ ID NO: 460912 - DNA, 512 bp, Homo sapiens
  misc_feature: HEFZJCU01AKHHF.48.73.G07.1.454.heavy.3.raw
agtatacatacacgaccggtgctcgatttagctctacgctcagggcacgaccggtgctcgatttagctctacgctcagggcacgaccggtgctcgatttagtagcatactgttgggtttgggagggctttgttggagaccttgcacttggactcctgtgccccaccatggacacactttgctccacgctcctgctgctgaccatcccttcatgggtcttgtcccagatcaccttgaaggagtctgggccaacgctggtgaacccacacagacctcacgctgacctgcaccttctctgggttctcactcaccactgatgaggtgggtgtggcctggatccgtcagcccccgggaaaggccccggagtggcttggattgatttatggggatggtgacaagcgttacagtgcatctctgaagaccagactctccatcaccaaggacacctccaagaacgaggttgtcctttccttggccaacatgcaccctgtggacacggccacttattttgta

SEQ ID NO: 460913 - DNA, 519 bp, Homo sapiens
  misc_feature: HEFZJCU01DD2GM.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccggggggtccctgagactgtcctgtgtagtctctgggttcagcgtcagtcgcgaccacatgagttggttccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtgggggcatttacttgacccctggggccggggaaccctggtcaccggt

SEQ ID NO: 460914 - DNA, 541 bp, Homo sapiens
  misc_feature: HEFZJCU01EOR08.15.86.H09.1.454.heavy.3.raw
tctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccaaggaaggggctggagtgggttggacgtttcaaaagtaaaatgatggtgagaaaatagactacggtgcacccgtgaaaggaagattcaccatctcaagagataattcaaaacgacggtgtattgcaaatgaacagcctgaaaaccgaggacacagccgtctattactgtaccacagattcggaagtgcatcgacgtaaaggaggctatgtcttttgatatctggggcccagggac

SEQ ID NO: 460915 - DNA, 497 bp, Homo sapiens; identical to SEQ ID NO: 445179
  misc_feature: HEFZJCU01C2EUJ.12.55.E11.1.454.heavy.3.raw

SEQ ID NO: 460916 - DNA, 491 bp, Homo sapiens; identical to SEQ ID NO: 446104
  misc_feature: HEFZJCU01DEP4J.3.34.D01.1.454.heavy.3.raw

SEQ ID NO: 460917 - DNA, 508 bp, Homo sapiens
  misc_feature: HEFZJCU01B2D28.3.17.B06.1.454.heavy.3.raw
agacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgacaaatgaacagcctgagaaccgacgacacggccgtctattattgtgtcatagacctaggatacaacgac

SEQ ID NO: 460918 - DNA, 499 bp, Homo sapiens
  misc_feature: HEFZJCU01ACRXY.26.23.C01.1.454.heavy.3.raw
agactatactcacgaccggtgctcgatttagtacacgtgattagggattgggaggcgtggtccagcctgggggctccctgagactctcctgtacaacgtctggattcaacttcaattattatgttctacactgggtccgccaggctccaggcaaggggctggagtgggtggcaggtatgtcacatgatggattcagtagatactacatagactccgtgaagggccgatcgaccatctccagagacgtttccgagaacacattaaatctggaaataaacttcgtgagaagtgacgactcggccgtttatttttgtgcgagagaggggtacagtagcggccgagctccggcctttgaccactggggccagggaaccctggtcaccgtctcctcagcctccaccaagggccatcggtcttcccctggcgccctgctccaggagcacctccgagagcacagcggcctgggctgcctggtcaaggactacttccagtatagtct

SEQ ID NO: 460919 - DNA, 508 bp, Homo sapiens; identical to SEQ ID NO: 448191
  misc_feature: HEFZJCU01CCONA.4.67.G01.1.454.heavy.3.raw

SEQ ID NO: 460920 - DNA, 516 bp, Homo sapiens; identical to SEQ ID NO: 447011
  misc_feature: HEFZJCU01B4JKC.3.20.B09.1.454.heavy.3.raw

SEQ ID NO: 460921 - DNA, 489 bp, Homo sapiens; identical to SEQ ID NO: 444791
  misc_feature: HEFZJCU01BA63J.47.85.H08.1.454.heavy.3.raw

SEQ ID NO: 460922 - DNA, 383 bp, Homo sapiens; identical to SEQ ID NO: 444477
  misc_feature: HEFZJCU01A5OJN.47.60.F05.1.454.heavy.3.raw

SEQ ID NO: 460923 - DNA, 527 bp, Homo sapiens
  misc_feature: HEFZJCU01DBVVU.53.64.F09.1.454.heavy.3.raw
cgcgtatacacacgaccggtgctcgatttagcgcgtatacaaggggtctgagagaggagcccagccctgggattttcaggtgttttcatgtggtgatcaggactgaacagagagaactcaccatggagtctgggctgacgtggctttttcttgtggctattttaaaaggtgtccagtgcgacgtgcagctggtggagtcggggggaggcttggtacagccgggggggtccctgagactctcctgtagagtctctggcttcacctttagagtctatgacatgagttgggtccgccaggctccggggaaggggctggagtgggtctcaacgatcagtgatagcggaagtaccacaaactacgccgcctccgtgaagggccgatgcaccgtctccagagacaattcgaaggacactttatatctgcaactcaacagactgacaaccgctgacacggccgtctattactgtgtcaaagaagacggaccgctggacgaggagccaggaggaaaatcactactttgactactc

SEQ ID NO: 460924 - DNA, 404 bp, Homo sapiens
  misc_feature: HEFZJCU01EO2RU.10.77.G11.1.454.heavy.3.raw
catagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcggggggggcaatggaccgtctggggccaagggaccacggtcaccgtctcctcagcctccaccaagggcccatcggtcttccccctggcaccctcctccaagagcacctctgggggcacagcggccctgggctgcctggtcaaggactacttcccactactatg

SEQ ID NO: 460925 - DNA, 493 bp, Homo sapiens
  misc_feature: HEFZJCU01AMURK.21.40.D07.1.454.heavy.3.raw
tcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagacatactatgtggactctgtgaagggccgattcaccatctccagagacaacgccaagagctcactgtatctgcaaatgaacagcctgagagtcgaggacacggctgtgtattactgtgcgagagatcccctcggtata

SEQ ID NO: 460926 - DNA, 517 bp, Homo sapiens; identical to SEQ ID NO: 449035
  misc_feature: HEFZJCU01ESD5N.26.71.G05.1.454.heavy.3.raw

SEQ ID NO: 460927 - DNA, 545 bp, Homo sapiens
  misc_feature: HEFZJCU01CZ5G9.13.40.D07.1.454.heavy.3.raw
tcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccaggggggggcctggagtggcttggaagcatctctcaaagcgggacgaccgactataacccgtcttttaggagtcgagtctcgatttcaatagacaggtctaagacacaattctccctgagggtgaccgtctatgtcggccgcggacgcggccgtctattactgtgcgcgaggatctccgtcggaacacttcgtgacaaggcaaacgtccgaagtcgttatcactttgactcctgggccagggaaccctggtcagcgtctcttcagcctccaccaacgggcccatcggtcttccccctggccaccctcctcccaagacgcacctctcgggggcacagcggccctggggcctgcct

SEQ ID NO: 460928 - DNA, 499 bp, Homo sapiens; identical to SEQ ID NO: 446805
  misc_feature: HEFZJCU01EUSK8.3.20.B09.1.454.heavy.3.raw

SEQ ID NO: 460929 - DNA, 491 bp, Homo sapiens; identical to SEQ ID NO: 444592
  misc_feature: HEFZJCU01EKLE9.11.26.C04.1.454.heavy.3.raw

SEQ ID NO: 460930 - DNA, 522 bp, Homo sapiens
  misc_feature: HEFZJCU01CNMVB.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtctccccctggccg

SEQ ID NO: 460931 - DNA, 509 bp, Homo sapiens
  misc_feature: HEFZJCU01COG8E.52.24.C02.1.454.heavy.3.raw
cgcagtacgacacgaccggtgctcgatttagtacagatcgttagggaaaggggctctgagagaggagccttagccctggattccaaggcctatccacttggtgatcagcactgagcaccgaggattcaccatggaattggggctccgctgggttttccttgttgctattttagaaggtgtccagtgtgaggtgcagctggtggagtctgggggaggcctggtcaagccgggggggtccctgagactctcctgtgcagcctctggattcaccttcagcagttatagcatgaactgggtccgccaggctccagggaaggggctggagtgggtctcatttattagtactagttacttatactacgcagactcagtgaagggccgattcaccatctccagagacaacgccaggaattcactatatttgcaaatgaacagcctgcgagccgaggacacggctgtgtattactgtgcgcgagaacacagcaatggccatttcgactactgggccg

SEQ ID NO: 460932 - DNA, 504 bp, Homo sapiens
  misc_feature: HEFZJCU01DG60Q.11.6.A06.1.454.heavy.3.raw
cgagagataccacgaccggtgctcgatttagatctactgacagggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtctgggggaggcttggtaaagccgggggggtcccttagactctcctgtgcagcctctggcatcactttcagtgacgcctggatgagctgggtccgccaggctccagggaaggggctggagtgggttggccgtattaaaagcgaggctgctggtgggacaacagactacgctgcacccgtgaagggcagattcaccatctccagagatgattcaaggagcacagtgtttctacaaatgaacagcctgactgccggggacactgccgtgtattactgtgccagcagcagcacctggccactatatttcttt

SEQ ID NO: 460933 - DNA, 500 bp, Homo sapiens
  misc_feature: HEFZJCU01CWXQK.17.10.A10.1.454.heavy.3.raw
  modified_base (460)..(460): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttcngtcatcgtacaatttgataggctctatggactggacttct

SEQ ID NO: 460934 - DNA, 519 bp, Homo sapiens; identical to SEQ ID NO: 450839
  misc_feature: HEFZJCU01CNC18.14.76.G10.1.454.heavy.3.raw

SEQ ID NO: 460935 - DNA, 400 bp, Homo sapiens; identical to SEQ ID NO: 444452
  misc_feature: HEFZJCU01A1J30.47.24.C02.1.454.heavy.3.raw

SEQ ID NO: 460936 - DNA, 471 bp, Homo sapiens
  misc_feature: HEFZJCU01EH0XN.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggcccatcggtcttcccctggcgccctgctccaggagcacctccgagagcacagccggccctgggctgcctggtcaaggactacttccctacagtgct

SEQ ID NO: 460937 - DNA, 494 bp, Homo sapiens; identical to SEQ ID NO: 456099
  misc_feature: HEFZJCU01ANXAM.13.86.H09.1.454.heavy.3.raw

SEQ ID NO: 460938 - DNA, 489 bp, Homo sapiens; identical to SEQ ID NO: 447707
  misc_feature: HEFZJCU01B0SL5.10.55.E11.1.454.heavy.3.raw

SEQ ID NO: 460939 - DNA, 533 bp, Homo sapiens
  misc_feature: HEFZJCU01DGXYH.48.34.D01.1.454.heavy.3.raw
agtatacatacacgaccggtgctcgatttagatcgtctgtgttgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaactgctttgtctctggaacttctatcaagggtagcagcttctactggggctggatccgccagcccccaggaaaggggctacaatgggttggaaatgtcaattcttatgggcgctcccactacaatccggccctccagagtcgagccctcatatccatagacacgtccaacaaccagttttccctgacgctgacgtctgtgaccgccgcagacacggctgtctattattgtgcgagactaggcttctgtagtggtggtacttgcaacccgggatactactccaacttcggcttggacatctggggccaaggggacctcggtcgtcccg

SEQ ID NO: 460940 - DNA, 510 bp, Homo sapiens
  misc_feature: HEFZJCU01EZTVH.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgaacgatgcaaaggagacctactatttggactctgtgaggggccgattcatcatctccagagacaacgccgacaactcactgtctctgctgatgagcagcctgagagccgacgacacggctatctattactgtgcgaaactctcattccgttcatctgaatactgggccagggaccctggtcgtccg

SEQ ID NO: 460941 - DNA, 505 bp, Homo sapiens; identical to SEQ ID NO: 444927
  misc_feature: HEFZJCU01CF83S.17.31.C09.1.454.heavy.3.raw

SEQ ID NO: 460942 - DNA, 519 bp, Homo sapiens
  misc_feature: HEFZJCU01BWBNQ.11.13.B02.1.454.heavy.3.raw
  modified_base (259)..(259): a, c, t, g, unknown or other
cgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccgccaggctccaggggaaggggctggagtgggtggccaacataaagccagatggaggtgtaaaacngtatgtagactctgtggagggccggttcaccatctccagagacaacgccaagaatgcgatatatctacagatgaacagcctgcgagccgaggacacgggctgtgtattactgtgggagtccctggctggcacctgtatccgaccgttggagtcagggaactctggtcaccgtctcctcagcctccaccaagggcccatcggtcttcccctggcgccctgctccaggagcgacctccgagagcacagcggccctcgggctc

SEQ ID NO: 460943 - DNA, 501 bp, Homo sapiens
  misc_feature: HEFZJCU01ANNCY.51.71.G05.1.454.heavy.3.raw
cgatcgtatacacgaccggtgctcgatttagtgtcgtcgcaagagagagggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttcccctggcaccctcctccaagagcacctctgggggcacagcggccctgggctgcctggtcaaggactacttcc

SEQ ID NO: 460944 - DNA, 429 bp, Homo sapiens; identical to SEQ ID NO: 447944
  misc_feature: HEFZJCU01CM94H.4.37.D04.1.454.heavy.3.raw

SEQ ID NO: 460945 - DNA, 484 bp, Homo sapiens
  misc_feature: HEFZJCU01B55EE.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctggcgccctgctccaggagcacctccgagagcacagcggccctgggctgcctcggtcaaggactacttcccactactatg

SEQ ID NO: 460946 - DNA, 523 bp, Homo sapiens
  misc_feature: HEFZJCU01ERROK.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggtctacttcgatctctggggccgt

SEQ ID NO: 460947 - DNA, 465 bp, Homo sapiens; identical to SEQ ID NO: 445132
  misc_feature: HEFZJCU01CHAVE.5.86.H09.1.454.heavy.3.raw

SEQ ID NO: 460948 - DNA, 477 bp, Homo sapiens; identical to SEQ ID NO: 444659
  misc_feature: HEFZJCU01E1U32.16.10.A10.1.454.heavy.3.raw

SEQ ID NO: 460949 - DNA, 518 bp, Homo sapiens; identical to SEQ ID NO: 448934
  misc_feature: HEFZJCU01DE4N0.7.78.H01.1.454.heavy.3.raw

SEQ ID NO: 460950 - DNA, 522 bp, Homo sapiens
  misc_feature: HEFZJCU01DKC7W.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgagacacgggcttctacttctgtgcgaggagtaattactataacactgctccttttacacctcccttgacttctgggcatggaacccggt

SEQ ID NO: 460951 - DNA, 508 bp, Homo sapiens
  misc_feature: HEFZJCU01B2L2I.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttccccctggccaccctcctccaagagcacctctgggggcacagcggccctgggctgcctggtcaaggactacttccgagtagtaca

SEQ ID NO: 460952 - DNA, 537 bp, Homo sapiens
  misc_feature: HEFZJCU01CKB1C.7.78.H01.1.454.heavy.3.raw
cgtgtctctacacgaccggtgctcgatttagtgtgagtagtttgggtttggggacccaacaaccacacccctcctaaaaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggccacg

SEQ ID NO: 460953 - DNA, 478 bp, Homo sapiens
  misc_feature: HEFZJCU01AEGJO.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctgggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 460954 - DNA, 508 bp, Homo sapiens
  misc_feature: HEFZJCU01BZ90S.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctctaattcgtggggccagggacg

SEQ ID NO: 460955 - DNA, 504 bp, Homo sapiens
  misc_feature: HEFZJCU01C0798.19.86.H09.1.454.heavy.3.raw
tactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaagggcaataagtggttcgtaccccg

SEQ ID NO: 460956 - DNA, 504 bp, Homo sapiens
  misc_feature: HEFZJCU01BGQ2C.13.87.H10.1.454.heavy.3.raw
tcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaaggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgcaaaagataccaaccccttacgtacg

SEQ ID NO: 460957 - DNA, 496 bp, Homo sapiens
  misc_feature: HEFZJCU01A4LWY.12.2.A02.1.454.heavy.3.raw
atacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgagtggatgggatggatcagcgcttacaatggtaacacagactatgcacagaagttccaggacagagtcaccatgaccacagacacatccacgagcacagcctacatggagctgaggagcctgagatctgacgacacggccgtgtattactgtgcgagaggttttagtgatacttattgtagtggtgtacctgtctactttttc

SEQ ID NO: 460958 - DNA, 502 bp, Homo sapiens
  misc_feature: HEFZJCU01BYYHV.10.34.D01.1.454.heavy.3.raw
catagtagtgcacgaccggtgctcgatttagatcgtctgtgttgggtttggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagcctggggggtcccttagactctcctgtgcagcctctggattcactttcagtaacgcctggatgaactgggtccgccaggctccagggaagggctggagtgggttggccatattaaaatcaaagctgatggtgggacaacagagcacgctgcacccgtgaaaggcagattcagcatctcaagagatgattcaaaaagtacgctgtatctgaacatgaacagcctagaaaacggaggacacagccgtgtattactgtgccactcaggaccgatattgtt

SEQ ID NO: 460959 - DNA, 513 bp, Homo sapiens
  misc_feature: HEFZJCU01EAXM7.53.85.H08.1.454.heavy.3.raw
cgcgtatacacacgaccggtgctcgatttagtatcactcagtcggggggacgcgtggtccagcctgggaggtccctgagactctcctgtgtagcctctggatttaccttcagggtctatgacatgcactgggtccgccaggctccaggcaaggggctggagtgggtggcacttatctcacatgatggaaataaaaaaactatggtgactccgtgaagggccgattctccgtctccagagacaattccaagaacaccttgtatctgcaaatgaacagcctgagatatgaggacacggctctgtattactgtgcgaaagaaaaggttactgtggaagagtgggagttattcgttggggaaggctttgatatctggggccaaggggacagtggtcacagtctcttcagcctccaccaagggcccatcggtcttcccctggcaccctcctccaagagcacctctgggggcacagcggccctgggctgcctggtcaaggactacttcctcgtactgcg

SEQ ID NO: 460960 - DNA, 518 bp, Homo sapiens
  misc_feature: HEFZJCU01B5C83.53.10.A10.1.454.heavy.3.raw
cgcgtatacacacgaccggtgctcgatttagcgtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgttctgcagatgcacaacttgagagtcgaagacacggcggtctattctgcgcgaggaaagtcgcattccagagcctgtacgcccgccttggtctcgtcagttggtcaatccgccctccagggggacctttggggtttcgacccctggggccagggaaccctggtcaccgtctcctcagcctccaccaagggccatcgtcttcccctggcaccctcctccagagcacctctgggggcacagcc

SEQ ID NO: 460961 - DNA, 537 bp, Homo sapiens
  misc_feature: HEFZJCU01AEB6D.13.35.D02.1.454.heavy.3.raw
tcacgtactacacgaccggtgctcgatttagcacacgatagttgggtttgggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtctggggggggcttggttaagcctgggggtccctcagactctcctgtgcaacctctggattcattttctctgacgcctggttgagctgggtccgccaggctcccgggaaggggctggagtgggttggccgtattaaaggtagaagacatggtcggacaacagactacagtgttcccgtgaaaggcagattcactatctcaagagatgactcaaaagaaatgatatatctgcaaatgaacaacctgaaaagcgaggacacaggcgtgtattactgtaccacagatgggccagatgcaaatggaccgcgacgagttcgactactggggcccgggaac

SEQ ID NO: 460962 - DNA, 534 bp, Homo sapiens
  misc_feature: HEFZJCU01D2QU3.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcctttttacaccttcccttgacttctggggtccagtcggaaccccggtccg

SEQ ID NO: 460963 - DNA, 484 bp, Homo sapiens
  misc_feature: HEFZJCU01CBLOI.47.59.F04.1.454.heavy.3.raw
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggcccatcggtcttccccctggcgccctgctccaggagcacctccgagagcacagcggccctcgggctgcctggtcaaggactacttcctacgtgagct

SEQ ID NO: 460964 - DNA, 429 bp, Homo sapiens; identical to SEQ ID NO: 447944
  misc_feature: HEFZJCU01CXQO1.4.37.D04.1.454.heavy.3.raw

SEQ ID NO: 460965 - DNA, 515 bp, Homo sapiens
  misc_feature: HEFZJCU01BB2IZ.48.26.C04.1.454.heavy.3.raw
agtatacatacacgaccggtgctcgatttagtctagcgactttgggtttggggaccccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgttgtattactgtgcgagagaagggttttacatgggttcggggagtctccgacccagccaactggttcgacccc

SEQ ID NO: 460966 - DNA, 513 bp, Homo sapiens
  misc_feature: HEFZJCU01AMLOT.53.41.D08.1.454.heavy.3.raw
cgcgtatacacacgaccggtgctcgatttagtcacgcgagaaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctggattcaccttcagggtctatgacatgcactgggtccgccaggctccaggcaaggggctggagtgggtggcagttatttcaaatgatggaagtaacaaatactatgtggactccgtgaagggccgattcaccatctccagagacaattccaagaatacgctgtatctgcacatgaacagcctgagagccgaagacacgggtgtttattactgtgcgaacttaattacggaggacaacggtaaccccgtcgcac

SEQ ID NO: 460967 - DNA, 506 bp, Homo sapiens
  misc_feature: HEFZJCU01DJB3K.11.59.F04.1.454.heavy.3.raw
cgagagataccacgaccggtgctcgatttagtacacacacttagggattggggctgggagaggagcccagcactagaagtcggcggtgtctccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgttcttcaaatgaacagcctgagagccgatgacacggccgtgtattactgtgcgagagatggggcccacgaacgttactacgctatgg

SEQ ID NO: 460968 - DNA, 532 bp, Homo sapiens; identical to SEQ ID NO: 449262
  misc_feature: HEFZJCU01A25LI.7.78.H01.1.454.heavy.3.raw

SEQ ID NO: 460969 - DNA, 510 bp, Homo sapiens
  misc_feature: HEFZJCU01ATLMR.3.71.G05.1.454.heavy.3.raw
agacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggattttccttttggctattttaaaaggtgtccggtgtgaagtgcaactggtggagtctgggggaggcttggtacagcctggcaggtccctgagactctcctgtgcagcctctggattcacctttgactgattatgccatgcactgggtccggcaagctccagggaagggcctggagtgggtctcaggtattacttggaatagtgataacatcggctatgcggactctgtgagggccgattcaccatctccagagacaacgccaagaactccctgtatctgcaatgaacagtctgagacctgaggacacggccttgtattactgtgtaaagtcccggggaaatatgtacgatttttac

SEQ ID NO: 460970 - DNA, 516 bp, Homo sapiens
  misc_feature: HEFZJCU01CHLJ8.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgagggccgcttcatcatctccagagacaattcccagaacatactgtctctgcaactcaataacctgagaggcgaggacacggccatttatttctgtgcgaaggaggcatatgggaagtacgattttcgatcctccgcagtcgacactttgattactggggccggggaaccctggtcgccgtctcctcagcctccaccaagggcccatcggtcttcccctggcaccctcctccaagagcacctctgggggcacagcggccctgggctgcctggtcaaggactacttccagacgtatca

SEQ ID NO: 460971 - DNA, 506 bp, Homo sapiens; identical to SEQ ID NO: 445682
  misc_feature: HEFZJCU01BITOL.48.44.D11.1.454.heavy.3.raw

SEQ ID NO: 460972 - DNA, 519 bp, Homo sapiens
  misc_feature: HEFZJCU01EO8SA.4.33.C11.1.454.heavy.3.raw
agcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatgaacagcctgaagaaccgaggacacagccgtctattactgtgttagggtagttttacgtatttttggtagtggatatttaa

SEQ ID NO: 460973 - DNA, 400 bp, Homo sapiens
  misc_feature: HEFZJCU01EPN5K.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcaagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 460974 - DNA, 520 bp, Homo sapiens
  misc_feature: HEFZJCU01CAW9F.47.53.E09.1.454.heavy.3.raw
agctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactcatttattgggatgatgtgaagtactacagtccatatttcaagaggctcactatcaccaaggacacttccaaaaaccaagtggtcctgacaatgaccaacgtgaagcctgcggacacggccacatattattgtgcacaccgacgctataccgccagctgggaaatcgacaactggttcgaccctggggccagggaacccttgtcaccgtctcctcagcctccaccaacgggccctacg

SEQ ID NO: 460975 - DNA, 500 bp, Homo sapiens
  misc_feature: HEFZJCU01DN2DN.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtggaggactgactacaacgcctccctcaggagtcgggtcaccatatcagtagacacgtccaagagccagttctccctgaagctgagggctgtgagcgcgcagacacggccgtgtattactgtgcgagactggccgcaacagactacggtggcaactcctatgcttttgatatcgtggggccaaggggac

SEQ ID NO: 460976 - DNA, 501 bp, Homo sapiens
  misc_feature: HEFZJCU01CQSVT.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatcggtcttcccctggcgcctgctcc

SEQ ID NO: 460977 - DNA, 522 bp, Homo sapiens
  misc_feature: HEFZJCU01AEX03.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtcttcccctggcgccctgctccaggagcacctccgagacgcacagccggccc

SEQ ID NO: 460978 - DNA, 536 bp, Homo sapiens
  misc_feature: HEFZJCU01BK7PD.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagtttttacgtggactctgtgaagggccgtttcaccatctccagagacaacgccaagaattcactgtatctacaactgaacagcctgagagtcgcagacacggccgtgtattactgtgcgagatgtggaaaaagtatggctgtgtttattgggggccagggagccctggtcaccg

SEQ ID NO: 460979 - DNA, 484 bp, Homo sapiens; identical to SEQ ID NO: 445876
  misc_feature: HEFZJCU01BQTN1.8.39.D06.1.454.heavy.3.raw

SEQ ID NO: 460980 - DNA, 479 bp, Homo sapiens; identical to SEQ ID NO: 450171
  misc_feature: HEFZJCU01AOSF2.14.70.G04.1.454.heavy.3.raw

SEQ ID NO: 460981 - DNA, 513 bp, Homo sapiens; identical to SEQ ID NO: 446699
  misc_feature: HEFZJCU01BYPFJ.12.25.C03.1.454.heavy.3.raw

SEQ ID NO: 460982 - DNA, 505 bp, Homo sapiens; identical to SEQ ID NO: 457508
  misc_feature: HEFZJCU01C5N88.47.55.E11.1.454.heavy.3.raw

SEQ ID NO: 460983 - DNA, 518 bp, Homo sapiens
  misc_feature: HEFZJCU01DESC9.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttctccctgaagctgagctctgtgactgccgcggacacggccgtgtattactgtgcgaggtcgattgtgatggtaacaactgcttcttactcctttgaccagtggggccggggaaccctggtcaccgtctcttcagcctccaccaagggcccatcggtcttcccctggcaccctcctccaagagcacctctggggcacagcc

SEQ ID NO: 460984 - DNA, 499 bp, Homo sapiens; identical to SEQ ID NO: 447792
  misc_feature: HEFZJCU01A1L52.17.10.A10.1.454.heavy.3.raw

SEQ ID NO: 460985 - DNA, 508 bp, Homo sapiens
  misc_feature: HEFZJCU01EX6AM.49.49.E05.1.454.heavy.3.raw
agtcgagagacacgaccggtgctcgatttagagcgactagcaacacacaaagggggctttctgagagtcatggatctcatgtgcaagaaagtgaagcacctgtggttcttcctcccgctggtggcggctcccagatgggtcctgtcccagctgcagctacaggagtcgggcccaggactgctgaagccttcggagaccctgtccctcacctgcactgtctctggtggttccttcagtagtccttattactactggggctgggtccgccagcccccagggaagggcctggagtggattgcgaatatctactatagtgggagcacctactacaatccttccctcaagagtcgcgtcactgtgtccgtggacacgtccaagaataaagtctccctgaacctgaactctgtgaccgccgcagacacggctgtctattactgtgccagaacgcggaaatccctacacaatgatgcttttgatgtctggggccatgggacaatggtcacgtctc

SEQ ID NO: 460986 - DNA, 490 bp, Homo sapiens
  misc_feature: HEFZJCU01CX5ER.10.1.A01.1.454.heavy.3.raw
catagtagtgcacgaccggtgctcgatttagacgtctcatcaggggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcagctggcggagtctgggggaggcgtggtccagcctgggaggtccctgagactctcctgtgcagcctctgggttcaccttcaatacctatggcatgcactgggtccgccaggctccaggcaaggggctggagtgggtggctcttatctcatatgatggaaatgttaaattttatgcagactccgtgaagggccgattcaccatctccagagacaattccaggaacaccctgtatctgcaaatgaacagcctgagagctgacgacacggctgtttattactgtgcgacagagcagctgacttaaac

SEQ ID NO: 460987 - DNA, 395 bp, Homo sapiens
  misc_feature: HEFZJCU01C93W9.18.31.C09.1.454.heavy.3.raw
tacgagtatgcacgaccggtgctcgatttagacgtctcatcaaggaaggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggtaatttgactggttattcctactacttgactactggggccagggcactccggtcaccgtctcctcagcctccaccaagggcccatcggtcttccccctggcaccctcctccaagagcacctctgggggcacagcggccctgggctgcctggtcaaggactacttcccatactcgta

SEQ ID NO: 460988 - DNA, 400 bp, Homo sapiens; identical to SEQ ID NO: 444452
  misc_feature: HEFZJCU01CP591.47.24.C02.1.454.heavy.3.raw

SEQ ID NO: 460989 - DNA, 423 bp, Homo sapiens; identical to SEQ ID NO: 444772
  misc_feature: HEFZJCU01CZZSP.16.78.H01.1.454.heavy.3.raw

SEQ ID NO: 460990 - DNA, 482 bp, Homo sapiens; identical to SEQ ID NO: 446046
  misc_feature: HEFZJCU01AGNPN.10.35.D02.1.454.heavy.3.raw

SEQ ID NO: 460991 - DNA, 507 bp, Homo sapiens
  misc_feature: HEFZJCU01D3RVS.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacacggcccccggacaagggcttgagtgggtggggtgggtcagcggctttggacggtaaggcacagtatgcaccgaagatgaagggcagagtcacgattaccacggaccacccccacgaacacagtctacatgcaactgacgagcctgagagctgacgacgacggccgtctattactgtgcgagaattgttttctgtcatcgtactatttgataggctctatggactggacttcgtc

SEQ ID NO: 460992 - DNA, 498 bp, Homo sapiens
  misc_feature: HEFZJCU01DCWR8.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagcgtgggtttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagatttctatagaggtgactacgggggcgttcg

SEQ ID NO: 460993 - DNA, 501 bp, Homo sapiens
  misc_feature: HEFZJCU01DUIWB.13.87.H10.1.454.heavy.3.raw
tcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaaggcctggagtgggtctcaggtattagttggaatagtggtagcataggctatgcggactctgtgaagggccgattcaccatctccagagacaacgccaagaactccctgtatctgcaatgaacagcctgagagctgaggacacggccttgtattattgtgcaaaagataccaaccccttacgtt

SEQ ID NO: 460994 - DNA, 494 bp, Homo sapiens
  misc_feature: HEFZJCU01DUJYB.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggccggttctccatctccagagacaattccaagaacacgctgtatctgcaattgaacagcctgagagccgaggacacggccgtatattactgtgcggaaagagtttggggaatgaccactc

SEQ ID NO: 460995 - DNA, 528 bp, Homo sapiens
  misc_feature: HEFZJCU01CKH5C.13.76.G10.1.454.heavy.3.raw
tcacgtactacacgaccggtgctcgatttagtcactcatacaggggggagaggagcccagcactgggattccgaggtgtttccattcggtgatcagcactgaacacagaggaaactcaccatggagttttggctgagctgggttttccttgttgctattttaaaaggtgcccagtgtgaggtgcagctggtggagtctggaggaggcttgatccagccgtgggggtccctgagactcccctgtgcagcctctgggttcaccgtcagtcacacctacatgagctgggtccgccaggctccgagggaaggggctggagtgcgtctcttttatttatagtagtggtagtacatactccgcagactccgtgagggccgattcaccatctccagagacaattccaagaacacgctgtttcttacaaatgaacagcctgagagccgatgacacggccgtgtattactgtgcgagagagtcggggcccacgaacgttactacgctatggacgtcgtggggcccaagggaccgacc

SEQ ID NO: 460996 - DNA, 505 bp, Homo sapiens
  misc_feature: HEFZJCU01DZOK4.53.33.C11.1.454.heavy.3.raw
cgcgtatacacacgaccggtgctcgatttagagtgagctcgttgggtttggggggaagaggaagactgacggtcctcccaggagttcaggtgctgggcaccgtgggcatgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgacccctgggccagggaaccctggtcaccgtctcctcagcttccaccaagggcccatcggtccttcccctcggcgccctgctcc

SEQ ID NO: 460997 - DNA, 393 bp, Homo sapiens; identical to SEQ ID NO: 446764
  misc_feature: HEFZJCU01D0341.49.42.D09.1.454.heavy.3.raw

SEQ ID NO: 460998 - DNA, 535 bp, Homo sapiens
  misc_feature: HEFZJCU01AYP1N.48.43.D10.1.454.heavy.3.raw
agtatacatacacgaccggtgctcgatttagactagcagtaagggggtgctttctgagagtcatggacctcctgcacaagaacatgaaacacctgtggttcttcctcctcctggtggcagctcccagatgggtcctgtcccaggtacagctacaacagtggggcgcaggacatttgaagccttcggagacgctgtccctcacctgcgctgtgtatggtgggtccttcaggggttacttctggacctggatccgccagcccccagggaaggggctggagtggattggggaggtcaggcatagtgccagggccacttacaacccgtccctcaacgatcgagtctccatcttagttgacacgtccaagaaccagttctcccttcaactcacgtctgtgaccgccgcggacacggctatatactactgtgcgagagggtccctggctctctccgcctttgacgcctggggccagggaaaactggtcaccgtctcctcagcttccaccaagggcccatcggtcttcccctcggcgccctg

SEQ ID NO: 460999 - DNA, 400 bp, Homo sapiens; identical to SEQ ID NO: 444452
  misc_feature: HEFZJCU01AYY1T.47.24.C02.1.454.heavy.3.raw

SEQ ID NO: 461000 - DNA, 511 bp, Homo sapiens
  misc_feature: HEFZJCU01BAG66.40.67.G01.1.454.heavy.3.raw
tctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattcttatgggcgctcccactacagtgcggccctccagagtcgagccctcatatccatagacacgtccaagaaccagttttccctgacgctgacgtctgtgaccgccgcagacacggctgtctattattgtgcgagactagccttctgtagtgggggtacttgcaaccgggatactactccaccttcggcttggacatctgggccg

SEQ ID NO: 461001 - DNA, 483 bp, Homo sapiens
  misc_feature: HEFZJCU01AH7QZ.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttgggcgtctggggccaagggaccacggtcatcgtctcctcagcctccaccaagggcccatcggtcttccccctggcaccctcctccaagagcacctctggggcacagcggccctgggctgcctggtcaaggactacttccgtatctctcg

SEQ ID NO: 461002 - DNA, 506 bp, Homo sapiens; identical to SEQ ID NO: 454268
  misc_feature: HEFZJCU01B1FAR.10.38.D05.1.454.heavy.3.raw

SEQ ID NO: 461003 - DNA, 508 bp, Homo sapiens
  misc_feature: HEFZJCU01ESF4D.49.81.H04.1.454.heavy.3.raw
agtcgagagacacgaccggtgctcgatttagtagtgtagattcgcggggagctctgggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctgggttcaccttcagggtctatgacatgcactgggtccgccaggctccaggcgaggggctggagtgggtggcagttatatcgaatgatggaagtaagaagtactatgcagactccgtgaagggccgattcaccatctccagagacaattccaagaacacgctatatttgcacatgaacagcctgagagctgaggacacggctatttattactgtgcgaacttaatcacggaggacaagggtgaccccgt

SEQ ID NO: 461004 - DNA, 482 bp, Homo sapiens; identical to SEQ ID NO: 444503
  misc_feature: HEFZJCU01DLOZW.7.10.A10.1.454.heavy.3.raw

SEQ ID NO: 461005 - DNA, 523 bp, Homo sapiens
  misc_feature: HEFZJCU01EJFPV.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgacccgtgaagggccgattaaccatctccagagacgattccgagaacacggtgtatcttcaaatgaacaacctgagagccgacgacacggccgtttattactgtgcgagagattcgagtggttcggggacctcaccctggtctacttcgatctctggggccgtc

SEQ ID NO: 461006 - DNA, 526 bp, Homo sapiens
  misc_feature: HEFZJCU01CMKOL.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcactctccctgaggctgagctctgtgacagccgcggacacgggcgtttattactgtgcgagagggacggactacggtgactactgggggttcgaccccgtggggccagggaaccctggtcaccgtctcctcagcctccaccg

SEQ ID NO: 461007 - DNA, 504 bp, Homo sapiens; identical to SEQ ID NO: 445696
  misc_feature: HEFZJCU01DVGCH.10.38.D05.1.454.heavy.3.raw

SEQ ID NO: 461008 - DNA, 521 bp, Homo sapiens
  misc_feature: HEFZJCU01EQF16.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccacttaggtttgactacgtggggccagggagcttggtcaccgtctcctcagcct

SEQ ID NO: 461009 - DNA, 521 bp, Homo sapiens; identical to SEQ ID NO: 453779
  misc_feature: HEFZJCU01DOAM1.16.10.A10.1.454.heavy.3.raw

SEQ ID NO: 461010 - DNA, 496 bp, Homo sapiens
  misc_feature: HEFZJCU01D9ALR.13.67.G01.1.454.heavy.3.raw
tcacgtactacacgaccggtgctcgatttagagtatacatattgggtctggggggggcttggtccagcctggggggtccctgagactctcctgtgcagcctctggattcacttttagtaggtattggatgggttgggtccgccagactccagagaagggactggagtgggtggccaacataaaggaagatggaagtgaaagatactatgtggactctgtgaagggccgattcaccatctccagagacaacgccaagaactcactgtatctgcagatgaccagcctgagagtcgaggatacggctgtgtattattgtgcgagagatggggcacgacattttgtagaggtgtactgggggccagggagccccggtcaccgtctcctcagcctccaccaagggcccatcggtcttccccctggcgccctgctccaggagcacctccgagagcacagcggccctgggctgcctggtcaaggactacttcctagtacgtga

SEQ ID NO: 461011 - DNA, 492 bp, Homo sapiens
  misc_feature: HEFZJCU01C8FS9.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccaggagacaattacaagaacatgctgtatctgcgattgaacaacgtcagagccgacgacacggcccactattattgtgcgagagagagaacattaaatttggcggctactacgagaacggattgggcgcctggggccaagggaccacggtcatcgtctccgcagcctccaccaagggcccatcggtcttccccctggccaccctcctccaagagcacctctgggggcacagcggccctgggctgcctggtcaggactacttccgagtgcgtct

SEQ ID NO: 461012 - DNA, 505 bp, Homo sapiens
  misc_feature: HEFZJCU01DJOL3.48.59.F04.1.454.heavy.3.raw
agtatacatacacgaccggtgctcgatttagtacacacacttagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctcctgaagctgagctctgtgaccgccgcagacacggctgtctattactgtgcgaggccccgagcgcagtggtcttttgatgtcctttgatatgtggggaccaagggacaagtggtccg

SEQ ID NO: 461013 - DNA, 435 bp, Homo sapiens
  misc_feature: HEFZJCU01DAGRF.14.74.G08.1.454.heavy.3.raw
cgtctagtaccacgaccggtgctcgatttagtagctctatcagggatccggcagctcccagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggtttttgatgtctggggccaggggacaatggtcaccgtctcttcagcctccaccaagggcccatcggtcttccccctggcaccctcctccaagagcacctctgggggcacagcggccctgggctgcctggtcaaggactacttccgtactagacg

SEQ ID NO: 461014 - DNA, 520 bp, Homo sapiens; identical to SEQ ID NO: 455517
  misc_feature: HEFZJCU01CL71J.13.76.G10.1.454.heavy.3.raw

SEQ ID NO: 461015 - DNA, 508 bp, Homo sapiens; identical to SEQ ID NO: 445594
  misc_feature: HEFZJCU01D3ZV3.17.25.C03.1.454.heavy.3.raw

SEQ ID NO: 461016 - DNA, 504 bp, Homo sapiens
  misc_feature: HEFZJCU01AGPQT.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcgggcatctccagagacaacggcaagagtatactgtatctggaaatgaacaatctgagagtcgacgatacggctgtctatcattgtgttttcgatgccttcgtccgcggactctgggcaggaccct

SEQ ID NO: 461017 - DNA, 512 bp, Homo sapiens
  misc_feature: HEFZJCU01CWISP.51.80.H03.1.454.heavy.3.raw
cgatcgtatacacgaccggtgctcgatttagctgtgcgtcgaagggaaaggggaggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagttgctgggaaggacatactacaggtccaagtggtttaatgattatgcagtatctgtgaaaagtcgaataaccatcaacccagacacatccaagaaccagttctccctgcaactgaactctgtgactcccgaggacacggccgtgtattactgtgcaagaggttggttaacagctggaggatttgactacgtggggccagggaaccctggtcaccgtctcctcagcctccaccaacgggcccatcggtcttcccctggccgccctgctccaggacgcacctccgagacgcacagcggcccgtc

SEQ ID NO: 461018 - DNA, 532 bp, Homo sapiens; identical to SEQ ID NO: 445228
  misc_feature: HEFZJCU01DUO50.7.78.H01.1.454.heavy.3.raw

SEQ ID NO: 461019 - DNA, 500 bp, Homo sapiens
  misc_feature: HEFZJCU01CS0WE.48.52.E08.1.454.heavy.3.raw
agtatacatacacgaccggtgctcgatttagtcgagctctcgttgggtttgggggattcccaggtgtttccattcagtgatcagcactgaacacagaggactcaccatggagttgggactgagcgtgagtttcctttaggctatttaaaagctgtccagtgtgaagtgcacctggtggagtctgggggaggcttggtacagcctggcaggtccctgagactctcctgtgcagcctctggattcacctttgatgattatgccatgcactgggtccggcaagttccagggaagggcctggagtgggtctcaggcattagtagaattaggggtagcataagcctatgcggattctgtgaagggccgattcaccatctccagagacaacgccaagaactccctgtatctgcaaatgaacagtctgagacctgaggacacggccttctattactgtgcaaaagatcaggcattagactacaacggtatgacgctggggccaaggg

SEQ ID NO: 461020 - DNA, 484 bp, Homo sapiens
  misc_feature: HEFZJCU01DSDTY.49.8.A08.1.454.heavy.3.raw
agtcgagagacacgaccggtgctcgatttagcatactctacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcatatgatggaagcaatatatactatgtagactccgtgaaggccgattcatcatctccagagacaattccgagaacacgctgtatctgcaaatgaacagcctgagagctgagacacggctgtgtattactgtgcgaacttaatcacggaggacg

SEQ ID NO: 461021 - DNA, 530 bp, Homo sapiens
  misc_feature: HEFZJCU01EV17G.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagaggggacggactacggtgactacttgggggttcgacccctgggggccagggaaccctggtcaccgtctcctcagcctccaaccg

SEQ ID NO: 461022 - DNA, 404 bp, Homo sapiens
  misc_feature: HEFZJCU01E1XV3.10.77.G11.1.454.heavy.3.raw
catagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcggggggggcgaatggacgtctggggccaagggaccacggtcaccgtctcctcagcctccaccaagggcccatcggtcttccccctggcaccctcctccaagagcacctctgggggcacagcggccctgggctgcctggtcaaggactacttcccactactatg

SEQ ID NO: 461023 - DNA, 534 bp, Homo sapiens; identical to SEQ ID NO: 449768
  misc_feature: HEFZJCU01BYTWD.17.28.C06.1.454.heavy.3.raw

SEQ ID NO: 461024 - DNA, 514 bp, Homo sapiens
  misc_feature: HEFZJCU01DWHTO.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcctgtgcagcctctgggttcaccttcagtagctacggcatgcactgggtccgccaagctccaggcaagggattggagtgggtggcagttgttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggagggggaaccagcgggagtccaagtacttccg

SEQ ID NO: 461025 - DNA, 516 bp, Homo sapiens
  misc_feature: HEFZJCU01CTV1G.46.67.G01.1.454.heavy.3.raw
  modified_base (242)..(242): a, c, t, g, unknown or other
actagcagtacacgaccggtgctcgatttagagtatacatattgggtttggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtancagcttccactggggctggatccgccagcccccaggaaaggggctccaatgcgttggacatgtcaattcttatgggcgctcccactacagtgcggccctccagagtcgagccctcatatccatagacacgtccaagaaccagtttccctgacgctgacgtctgtgaccgccgcagacacggctgtctattattgtgcgagactagccttctgtagtgggggtacttgcaaccgggatactactccaccttcggcttggacatctggggccgtac

SEQ ID NO: 461026 - DNA, 523 bp, Homo sapiens
  misc_feature: HEFZJCU01AEX3O.18.33.C11.1.454.heavy.3.raw
tacgagtatgcacgaccggtgctcgatttagagtgagctcgttgggtttgggggggagaggagcccagcactgggattctgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctggggcccggggaaccctggtcaccgtctccccaccct

SEQ ID NO: 461027 - DNA, 511 bp, Homo sapiens
  misc_feature: HEFZJCU01BB6FJ.48.5.A05.1.454.heavy.3.raw
agtatacatacacgaccggtgctcgatttagatagatagacaggggctgggagaggagctccagccttgggattcccagctgtctccactcggtgatcggcactgaatacaggagactcaccatggagtttgggctgaactgggttttccttgttgctattttaaaaggtgtccagtgtgaggtgcagctggtggagtccgggggagccttggttcagcctggggggtctctgaaactctcctgtgcagcctctgggttcatgttcaatgtctctgctattcactgggtccgccaggcttccgggaaagggctggaatgggttggtcgtattagaactaaagtaaatagttacgcgacagcagatgctgcgtcggtgaaaggcaggttcaccatctccagagatgattcaaagaacacggcgtatctgcaaatgaacagcctgaaaaccgaggacacggccatttattttgtgctagatctgaagaattaccagctgctgtgttctccccc

SEQ ID NO: 461028 - DNA, 534 bp, Homo sapiens
  misc_feature: HEFZJCU01BMH73.48.12.B01.1.454.heavy.3.raw
agtatacatacacgaccggtgctcgatttagtagtgtagattccgcgggcacgaccggtgctcgatttagcgcagtacgaagggaggcttggtccagcctggggggtccctgaaactctcctgtacagcctctgggttcgccttcacagcctctgggttcagcttcagtgcctctgctatgcactgggtccgccaggcttccggggagagggcttgagtgggttggccgtattagaacaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattgggccagggaaccctggtcgccgtctcctcagcctccaccaagggcccatcggtcttccccctggcgccctgctccaggagcacctccgagagcacagcggccctgggctgcctggtcagactacttcct

SEQ ID NO: 461029 - DNA, 318 bp, Homo sapiens; identical to SEQ ID NO: 452347
  misc_feature: HEFZJCU01CDT3E.13.66.F11.1.454.heavy.3.raw

SEQ ID NO: 461030 - DNA, 482 bp, Homo sapiens
  misc_feature: HEFZJCU01BY96O.47.59.F04.1.454.heavy.3.raw
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggcccatcggtcttccccctgcgccctgctccaggagcacctccgagagcacagcggccctgggctgcctggtcaaggactacttcctacgtgagct

SEQ ID NO: 461031 - DNA, 490 bp, Homo sapiens
  misc_feature: HEFZJCU01ADZ2L.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttccccctggcgccctgctccaggagcacctctgggggcacagcggccctgggctgcctggtcaaggactacttcccatactcgta

SEQ ID NO: 461032 - DNA, 488 bp, Homo sapiens
  misc_feature: HEFZJCU01EHD5X.52.76.G10.1.454.heavy.3.raw
cgcagtacgacacgaccggtgctcgatttagtcactcatacaggggtctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctgggggaggcgtggtccagcctgggaggtccctgagactctcctgtgcaggctctgcatttcccttcaataactatgctatcgattgggtccgccaggctccaggcaagggactggagtgggtggcagtaatatcagctgatggaggcactaaatattacgcagattctgcgaggggccgattcaccatatccagagacaactcccaagatatgatatatctacaaatgaacagcctgagacctgaggacacggctgtatattactgtgcgtcgagggggcagtcgctc

SEQ ID NO: 461033 - DNA, 391 bp, Homo sapiens; identical to SEQ ID NO: 444994
  misc_feature: HEFZJCU01BF3JC.40.58.F03.1.454.heavy.3.raw

SEQ ID NO: 461034 - DNA, 503 bp, Homo sapiens
  misc_feature: HEFZJCU01EK2AW.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctggaccacgtggggaccg

SEQ ID NO: 461035 - DNA, 390 bp, Homo sapiens; identical to SEQ ID NO: 447143
  misc_feature: HEFZJCU01AIQC9.48.70.G04.1.454.heavy.3.raw

SEQ ID NO: 461036 - DNA, 491 bp, Homo sapiens; identical to SEQ ID NO: 446104
  misc_feature: HEFZJCU01EIKS3.3.34.D01.1.454.heavy.3.raw

SEQ ID NO: 461037 - DNA, 499 bp, Homo sapiens
  misc_feature: HEFZJCU01DJPN9.12.2.A02.1.454.heavy.3.raw
  modified_base (420)..(420): a, c, t, g, unknown or other
atacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgagtggatgggatggatcagcgcttacaatggtaacacagactatgcacagaagttccaggacagagtcaccatgaccacagacacatccacgagcacagcctacatggagctgaggagcctgggganatctgacgacacggccgtgtattactgtgcgagtaggttttagtgatacttattgtagtggtggtacctgctacttttc

SEQ ID NO: 461038 - DNA, 505 bp, Homo sapiens
  misc_feature: HEFZJCU01D87YC.11.57.F02.1.454.heavy.3.raw
cgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgccaggctccaggtaagggctggaatggatttcatacattagcagtagtggtgtgaccatatactacgcagactctgtgaagggccgattcatcatctccagagacaatggcaacaactcactgtatctggaaatcaacagcctgagagtcgaggacacgg

SEQ ID NO: 461039 - DNA, 504 bp, Homo sapiens
  misc_feature: HEFZJCU01C22UO.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtctgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgttgtttcgatgccttcggtccgcggctcgtgggccgtac

SEQ ID NO: 461040 - DNA, 500 bp, Homo sapiens
  misc_feature: HEFZJCU01B8DT8.21.85.H08.1.454.heavy.3.raw
tcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctattttaaaaggtgtccagtgtgaggtgcagctggtgcagtctgggggagctgtggtacggcctggggggtccctgagactctcctgtgaagcctctggattcacctttgatgattatggcatggcctgggtccgccaagctccagggaaggggctggagtgggtctctggtataaattacaatggaggtcacacagcttatagagactctgtgaggggccgattcaccatctccagagacagcgccaagaactccctgtatctgcaaatgaacagtctgagagccgaggacacggccttatattactgtgcgcgtgatgggtggtgccttttccg

SEQ ID NO: 461041 - DNA, 484 bp, Homo sapiens; identical to SEQ ID NO: 452423
  misc_feature: HEFZJCU01D9BK0.47.59.F04.1.454.heavy.3.raw

SEQ ID NO: 461042 - DNA, 407 bp, Homo sapiens; identical to SEQ ID NO: 448185
  misc_feature: HEFZJCU01CA4JH.11.70.G04.1.454.heavy.3.raw

SEQ ID NO: 461043 - DNA, 500 bp, Homo sapiens
  misc_feature: HEFZJCU01A3CMI.51.71.G05.1.454.heavy.3.raw
cgatcgtatacacgaccggtgctcgatttagtgtcgtcgcaagagagagggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttcccctggcaccctcctccaagagcacctctgggggcacagcggcctgggctgcctggtcaaggactacttcc

SEQ ID NO: 461044 - DNA, 509 bp, Homo sapiens
  misc_feature: HEFZJCU01BDWD4.48.75.G09.1.454.heavy.3.raw
agtatacatacacgaccggtgctcgatttagtatagacatcagggggactcctgtgccccaccatggacacactttgctccacgctcctgctgctgaccatcccttcatgggtcttgtcccagatcaccttgaaggagtctggtcctacgctggtgaaacccacacagaccctcacactgacctgcaccttctcgggcttctcactcactcgtagtggggaggctgtggcctggattcgtcagcccccagggaaggccctggagtggcttgctctcatttactgggatactgatgaccgctacactccagctctgaaaacaggctcaccatcgccatggacacctccaaaaacaggtggtccttaaatgaccaacatggacccaatggacagcgcgacatattactgtgcacacattgattgtggtcccaccaggtgtcccgggccctttgatatctggggccgggggacattcgtcaccgtctctgcagcctccaccaagggcctacg

SEQ ID NO: 461045 - DNA, 492 bp, Homo sapiens
  misc_feature: HEFZJCU01DLRUJ.49.48.E04.1.454.heavy.3.raw
agtcgagagacacgaccggtgctcgatttagagagcgtcacagagagaagggggcatcatccaacaaccacatcccttctctacagaagcctctgagagggaagttcttcaccatggactggacctggagggtcttctgcttgctggctgtagctccgggtgctcactcccaggtgcagttggtgcagtctggggctgaggtgaagaagtctggggcctcagtgaagatttcctgcaaggcttctggataccccttcaccatctaccacatgcactgggtgcgacaggccccgggacaagggcttgagtggatgggaataatcaaccctagtggtggtagcacaacctccgcacagaggttccagggcagagtcaccatgaccagggacacgtccacgagcacattctacatggaactgagccgcctgagatctgacgacacggccgtgtactactgtgcgagagtcactcattactacgatagtttatggt

SEQ ID NO: 461046 - DNA, 489 bp, Homo sapiens; identical to SEQ ID NO: 444591
  misc_feature: HEFZJCU01D3E4A.18.70.G04.1.454.heavy.3.raw

SEQ ID NO: 461047 - DNA, 513 bp, Homo sapiens
  misc_feature: HEFZJCU01EXKC3.52.78.H01.1.454.heavy.3.raw
  modified_base (504)..(504): a, c, t, g, unknown or other
cgcagtacgacacgaccggtgctcgatttagtgtgagtagtttgggtttgggaccggtgctcgattcagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggccgtggcaccctggtcactgtcttctcagcctccaccagggcccatcggtcttccccctggccaccctcctccaanagcacctcg

SEQ ID NO: 461048 - DNA, 489 bp, Homo sapiens; identical to SEQ ID NO: 444591
  misc_feature: HEFZJCU01D4UC2.18.70.G04.1.454.heavy.3.raw

SEQ ID NO: 461049 - DNA, 508 bp, Homo sapiens
  misc_feature: HEFZJCU01BZ3L7.48.23.C01.1.454.heavy.3.raw
agtatacatacacgaccggtgctcgatttagtacacgtgattagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggggtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtcttttgatgcctttgattatgtggggccaagggacaatggtcaccgtctt

SEQ ID NO: 461050 - DNA, 512 bp, Homo sapiens; identical to SEQ ID NO: 459912
  misc_feature: HEFZJCU01BE1GD.48.19.B08.1.454.heavy.3.raw

SEQ ID NO: 461051 - DNA, 521 bp, Homo sapiens
  misc_feature: HEFZJCU01DX7N0.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggccagggaaccctggtgaccgtctcctcagcctccaccaagggcccatcggtcttcccctggcgccctgctccaggagcacctccgagacgcacagcggccct

SEQ ID NO: 461052 - DNA, 400 bp, Homo sapiens
  misc_feature: HEFZJCU01BUTIP.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgagctgcctggtcaaggactacttcctacgtgagct

SEQ ID NO: 461053 - DNA, 523 bp, Homo sapiens
  misc_feature: HEFZJCU01CB4IL.53.57.F02.1.454.heavy.3.raw
cgcgtatacacacgaccggtgctcgatttagctcgatatagttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctggattcaccttcagggtctatgacatgcactgggtccgccaggctccaggcaaggggctggagtgggtggcagttatatcaaatgatggaagtaagaaatactatgtagactccgtgaagggccgattcaccatctccagagacaattccaagaatacgctgtatctgcacatgaacagcctgagagccgaagacacgggtgtttattactgtgcgaacttaattacggaggacaacggtaaccccgtccgcacggtacggtacg

SEQ ID NO: 461054 - DNA, 479 bp, Homo sapiens
  misc_feature: HEFZJCU01BD493.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctggcgccctgctccaggagcacctccgagagcacagcggcctggctgcctggtcaggactacttccactactatg

SEQ ID NO: 461055 - DNA, 375 bp, Homo sapiens
  misc_feature: HEFZJCU01APFHO.3.23.C01.1.454.heavy.3.raw
agacgcactccacgaccggtgctcgatttagtacacgtgattagggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgtgcgaggacaatctgtgccggtgactgctacgtcgatttctggggccagggaaccctggtcaccgtctcctcagcctccaccaagggcccatcggtcttccccctggcaccctcctccaagagcacctctgggggcacagcggccctgggctgcctggtcaaggactacttccgagtgcgtct

SEQ ID NO: 461056 - DNA, 506 bp, Homo sapiens; identical to SEQ ID NO: 446520
  misc_feature: HEFZJCU01DYYPO.10.38.D05.1.454.heavy.3.raw

SEQ ID NO: 461057 - DNA, 500 bp, Homo sapiens; identical to SEQ ID NO: 450218
  misc_feature: HEFZJCU01DMMIU.17.10.A10.1.454.heavy.3.raw

SEQ ID NO: 461058 - DNA, 382 bp, Homo sapiens
  misc_feature: HEFZJCU01AL6MO.47.60.F05.1.454.heavy.3.raw
agctcacgtacacgaccggtgctcgatttagtacgtcatcagggaaagggactggagtggattggctatctgtattacggtgggagttcaaacttcaacccctccctcaagagtcgagtcaccatttcaggagacacgtccaagaatcaggtctccttgaacctgaggcagacgaccccagcggacacggccgtctattattgtgcgagaggtcttcttgatgacgatgccctggacgactggggccagggagtccttgtcaccgtctcctcagcctccaccaaggcccatcggtcttccccctggcaccctcctccaagagcacctctgggggcacagcggccctgggctgcctggtcaaggactacttcctacgtgagct

SEQ ID NO: 461059 - DNA, 516 bp, Homo sapiens
  misc_feature: HEFZJCU01CW4QF.51.5.A05.1.454.heavy.3.raw
cgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagcccgtcggagaccctgtccctcagctgcgctgtatatcgtgggtccttcagtggttactactggagctggatccgccagtccccaggggaaggggctggagtggatagggcgaatcaatcatagtggagacaccgactacaacccgtccctcatgagtcgagtcaccatgtcagtggactcgtccaagagtgagttctccctgaggctgacgtctttaagtgtcgctgatacgggtgtctatttctgtgcgagactgcccggtcctgcacctcgtgtcggccccaatttggtttaccggcacacaaatcagggcaagtcctacgacggtctggaccg

SEQ ID NO: 461060 - DNA, 518 bp, Homo sapiens; identical to SEQ ID NO: 445423
  misc_feature: HEFZJCU01CACPG.7.78.H01.1.454.heavy.3.raw

SEQ ID NO: 461061 - DNA, 507 bp, Homo sapiens; identical to SEQ ID NO: 458851
  misc_feature: HEFZJCU01CLKN2.16.34.D01.1.454.heavy.3.raw

SEQ ID NO: 461062 - DNA, 513 bp, Homo sapiens
  misc_feature: HEFZJCU01CX2YW.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactactggggcctgggaactcgtgtcaccgtct

SEQ ID NO: 461063 - DNA, 512 bp, Homo sapiens
  misc_feature: HEFZJCU01CTOP2.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgttcatctgagggcagtgttcaatggtatgcagactccgtgaagggccgattcaccatctccagagacaattccaggaacacaatgtatttggagctgaacagcctaagtcctgaggacacgggcgtatactactgtacgaagggagggggaaccagcgggagtccaagtactccttgtacg

SEQ ID NO: 461064 - DNA, 518 bp, Homo sapiens
  misc_feature: HEFZJCU01DCWYW.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccaagagcacctctgggggcacagcggccctgggctgcctggtcaaggactacttcctagagacag

SEQ ID NO: 461065 - DNA, 483 bp, Homo sapiens; identical to SEQ ID NO: 444924
  misc_feature: HEFZJCU01C6TOB.10.35.D02.1.454.heavy.3.raw

SEQ ID NO: 461066 - DNA, 517 bp, Homo sapiens; identical to SEQ ID NO: 454763
  misc_feature: HEFZJCU01B7Q07.3.17.B06.1.454.heavy.3.raw

SEQ ID NO: 461067 - DNA, 505 bp, Homo sapiens
  misc_feature: HEFZJCU01BJRIJ.48.59.F04.1.454.heavy.3.raw
agtatacatacacgaccggtgctcgatttagtacacacacttagggattggggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtgcttttgatgcctttgatatgtgggcaagggacaatgtcaccgtctcttcagcctccaccaacggg

SEQ ID NO: 461068 - DNA, 480 bp, Homo sapiens
  misc_feature: HEFZJCU01ACV3A.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggtccgcggccgactactggggccagggcaccctggtcaccgtctcttcagcctccaccaagggcccatcggtcttcccctggcgccctgctccaggagcacctccgagagcacagcggccctgggctgcctggtcaaggactactccacgcgtatgt

SEQ ID NO: 461069 - DNA, 520 bp, Homo sapiens; identical to SEQ ID NO: 460155
  misc_feature: HEFZJCU01EJFE1.13.63.F08.1.454.heavy.3.raw

SEQ ID NO: 461070 - DNA, 488 bp, Homo sapiens
  misc_feature: HEFZJCU01EGWUX.49.4.A04.1.454.heavy.3.raw
agtcgagagacacgaccggtgctcgatttagagtagtgatcagggggggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgctgcctctggattcaccttcagggtctatgacatgcactgggtccgccaggctccaggcaaggggctggagtgggtggcatttatctcatatgatggaagcaagatatactacattgactccgtgaagggccgattcatcatctccagagacaactccgagaacacactgtatcttcaaatgaacaggttgagagctgaagacacggctttatattactgtgcgaaacttatcacggaggacaac

SEQ ID NO: 461071 - DNA, 534 bp, Homo sapiens
  misc_feature: HEFZJCU01EAV1M.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttacaaatgaataacctgagagccgaggacacggccatgtattactgtgtggggcagtttacttgacccctgggggcccggggaacccgtggtcaccgtctccccacctccacccg

SEQ ID NO: 461072 - DNA, 398 bp, Homo sapiens
  misc_feature: HEFZJCU01BC4QY.7.60.F05.1.454.heavy.3.raw
cgtgtctctacacgaccggtgctcgatttagtacgtcatcaggctccagggaaggggctggagtgggtctcagtgatttatagtagttccagttcatttcacgcagactccgtgaagggccgattcaccatctccagagacatttccaagaacacggtggatcttcagatggacagcctcagagcggaggacacggctgtctattactgtgtgagaggcgccaccggtggggatggaaacgattttcttgtttgtctggggccagggaaccctggtcaccgtctcctcagcctccaccaagggcccatcggtcttcccctggcgccctgctccaggagcacctccgagagcacagcggccctgggctgcctggtcaaggactacttcctagagacacg

SEQ ID NO: 461073 - DNA, 517 bp, Homo sapiens; identical to SEQ ID NO: 446832
  misc_feature: HEFZJCU01DBNTX.14.66.F11.1.454.heavy.3.raw

SEQ ID NO: 461074 - DNA, 432 bp, Homo sapiens; identical to SEQ ID NO: 444920
  misc_feature: HEFZJCU01E0ZB3.11.39.D06.1.454.heavy.3.raw

SEQ ID NO: 461075 - DNA, 439 bp, Homo sapiens
  misc_feature: HEFZJCU01D182M.19.25.C03.1.454.heavy.3.raw
tactctcgtgcacgaccggtgctcgatttagtagtgtagatttgggtttggggctgccctttggctttggagatggttttctcgatgggggctgggagggctttgttggagaccttgcacttgtactccttgtcattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatgagggtgtccttgggttttgggggaagaggaagactgacggtccccccaggagttcaggtgctgggcacagcggcctgggctgcctggtcaaggactacttcccacgagagta

SEQ ID NO: 461076 - DNA, 400 bp, Homo sapiens; identical to SEQ ID NO: 444452
  misc_feature: HEFZJCU01A6HYE.47.24.C02.1.454.heavy.3.raw

SEQ ID NO: 461077 - DNA, 403 bp, Homo sapiens; identical to SEQ ID NO: 444658
  misc_feature: HEFZJCU01A7UGG.14.60.F05.1.454.heavy.3.raw

SEQ ID NO: 461078 - DNA, 402 bp, Homo sapiens; identical to SEQ ID NO: 444584
  misc_feature: HEFZJCU01BSR0P.10.77.G11.1.454.heavy.3.raw

SEQ ID NO: 461079 - DNA, 422 bp, Homo sapiens; identical to SEQ ID NO: 444734
  misc_feature: HEFZJCU01C8XIC.16.78.H01.1.454.heavy.3.raw

SEQ ID NO: 461080 - DNA, 515 bp, Homo sapiens
  misc_feature: HEFZJCU01C4W7J.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggttatttttataggtgggacgacattctacggagactccatggagggccgattcaccatctccagagacttttctcagaacacactgtctcttcaaatgaacagcctgaggccgaggacacggccgtctattattgtgtgagagtttatggcgatggctgggtggacagatcactggggccaac

SEQ ID NO: 461081 - DNA, 512 bp, Homo sapiens; identical to SEQ ID NO: 450914
  misc_feature: HEFZJCU01DF8O8.15.67.G01.1.454.heavy.3.raw

SEQ ID NO: 461082 - DNA, 503 bp, Homo sapiens; identical to SEQ ID NO: 445995
  misc_feature: HEFZJCU01DNFPQ.17.25.C03.1.454.heavy.3.raw

SEQ ID NO: 461083 - DNA, 491 bp, Homo sapiens; identical to SEQ ID NO: 446104
  misc_feature: HEFZJCU01BV8V7.3.34.D01.1.454.heavy.3.raw

SEQ ID NO: 461084 - DNA, 519 bp, Homo sapiens
  misc_feature: HEFZJCU01AINLG.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaactcctactacggtctggacgtctggggccgaggggacctac

SEQ ID NO: 461085 - DNA, 507 bp, Homo sapiens
  misc_feature: HEFZJCU01DPW6D.11.6.A06.1.454.heavy.3.raw
cgagagataccacgaccggtgctcgatttagatctactgacagggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtctgggggaggcttggtaaagccgggggggtcccttaggactctcctgtgcagcctctggcatcactttcagtgacgcctggatgagctgggtccgccaggctccagggaaggggctggagtgggttggccgtattaaaagcgaggctgctggtgggacaacagactacgctgcacccgtgaagggcagattcaccatctccagagatgattcaaggagcacagtgtttctacaaatgaacagcctgactgccggggacactgccgtgtattactgtgccagcagcagcacctggccactatatttctttcg

SEQ ID NO: 461086 - DNA, 504 bp, Homo sapiens
  misc_feature: HEFZJCU01CCIZ1.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttcccctggcgccctgctccaggagcacctccgagagcacagcggccctgggctgcctggtcaaggactacttcccactact

SEQ ID NO: 461087 - DNA, 482 bp, Homo sapiens; identical to SEQ ID NO: 444503
  misc_feature: HEFZJCU01C1Q6E.7.10.A10.1.454.heavy.3.raw

SEQ ID NO: 461088 - DNA, 525 bp, Homo sapiens
  misc_feature: HEFZJCU01DR1AO.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagtaatctggagctgaacagcctgtcatctgaggacacgggcttctacttctgtgcgaggagtaattactatacactgctccttttacacctcccttgacttctgggccatggaacccggtccg

SEQ ID NO: 461089 - DNA, 316 bp, Homo sapiens
  misc_feature: HEFZJCU01DCMGW.47.84.H07.1.454.heavy.3.raw
agctcacgtacacgaccggtgctcgatttagcagacgtctgtcgcggggccgattcaccgtctccagagacaattccaagaacacgctatatttgcaaatgaacagcctgagacctgaagacacggctgtgtattactgtacgagaccttatggcggggactactttgactactggggccagggaaccctggtcaccgtctcctcagcctccaccaagggcccatcggtcttccccctggcaccctcctccaagagcacctctgggggcacagcggccctgggctgcctggtcaaggactacttcctacgtgagct

SEQ ID NO: 461090 - DNA, 494 bp, Homo sapiens
  misc_feature: HEFZJCU01AI9KF.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctggaggacacggctgtgtattactgtgggagagagtggaggtcgatattgt

SEQ ID NO: 461091 - DNA, 531 bp, Homo sapiens
  misc_feature: HEFZJCU01A4XWM.12.40.D07.1.454.heavy.3.raw
atacgacgtacacgaccggtgctcgatttagtgatagagcgtaacaacagagggctcaccatggagtttgggctgagcgtgggttttccgtcgttaggctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttcccctggcgccgtcg

SEQ ID NO: 461092 - DNA, 505 bp, Homo sapiens
  misc_feature: HEFZJCU01B1OLA.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaaccctccaccggcacagcctacatggagctgagcagtctgacacctgacgacacggccgtctattactgtgcgagagccgcgaatatgtggtgcaaagatggtcgttgttgttttggccggtgaactactggggccagggcaccctggtcaccgtctcctcagcttccaccaagggcccatcggtcttcccctggcgccctgctccagagcacctctggggcacagcggcctgggctgcctggtcaggactacttcccata

SEQ ID NO: 461093 - DNA, 529 bp, Homo sapiens
  misc_feature: HEFZJCU01E1IIV.9.30.C08.1.454.heavy.3.raw
tgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgactccatcaccggtactaattactactggagttggatccgccagccccccgggaagggcctggagtggattggatacgccttttacagtggagtcacctactacaacccgtccctcaagagccgagttaccatatctgtcgacacgtcccagaatcagttctccctggaggtgacctctgtgactgccgcagactcggccgtgtatttctgtgccagaacgcaaagcagcgcctactatactttaaactttgacttctggggccagggactccctggtcaccgtctcctcacgcctccc

SEQ ID NO: 461094 - DNA, 502 bp, Homo sapiens; identical to SEQ ID NO: 444768
  misc_feature: HEFZJCU01A2AW4.21.70.G04.1.454.heavy.3.raw

SEQ ID NO: 461095 - DNA, 502 bp, Homo sapiens
  misc_feature: HEFZJCU01BSKIY.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtcttccccctggcgccctgctccaggagcacctccgacgagcacagcggcctgggctgcctggtcaaggactacttcctacgtcgtact

SEQ ID NO: 461096 - DNA, 312 bp, Homo sapiens
  misc_feature: HEFZJCU01C1YIL.18.53.E09.1.454.heavy.3.raw
tacgagtatgcacgaccggtgctcgatttagagagagtgtgttggggttgggtgcccaagctgctggagggcacggtcacccacgctgctcgagcagcctgagatctgaggacacggccgtgtattactgtgctagagagggacgtatagtgggagctccctttgacccctgggccggggaaccctggtcaccgtctccccaccctccaccaagggcccatcggtcttccccctggcacccgtcctccaagagcacctctggggcacagcggccctgggctgcctggtcaaggactacttcccatactcgta

SEQ ID NO: 461097 - DNA, 512 bp, Homo sapiens
  misc_feature: HEFZJCU01BTPZ0.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcacgtctccgcagcctccaccaagggccc

SEQ ID NO: 461098 - DNA, 481 bp, Homo sapiens; identical to SEQ ID NO: 445517
  misc_feature: HEFZJCU01CNEI3.22.36.D03.1.454.heavy.3.raw

SEQ ID NO: 461099 - DNA, 567 bp, Homo sapiens
  misc_feature: HEFZJCU01B1OEG.49.10.A10.1.454.heavy.3.raw
agtcgagagacacgaccggtgctcgatttagcgtcgatctcagggggctctgggagacgagcccagcactggaagtcgccggtgtttccattcggtgatcatcactgaacacagaggactcaccatggagtttgggctgagctgggttttcctcgctgctcttttaagagacgtccactgttttgtgggcctggtggagtctgggggggcgtggtccagcccgggaggtccctcagactctcctgtacagacccgacatcttacgtcaggattaataatgtacactggatccgccaggccccaggcaaggggctggagtgggtggcattggtgactcatgtggaagacagaaaattgtacgcagactccgtgaggggccgattcatcatctccaaagactactccaagaatacggtgtatcttcaaatgaatggcctcgtttttgcggacacggctgtttattattgtgcgacgacggggggcccccgtttcccgtacggtacggcggaacgtctataccttaactttacgtacctaaccgtcgggggtccggacggggaacccgtc

SEQ ID NO: 461100 - DNA, 527 bp, Homo sapiens
  misc_feature: HEFZJCU01AMF2D.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctccctgacttctgggccatcggaacccggtccg

SEQ ID NO: 461101 - DNA, 515 bp, Homo sapiens
  misc_feature: HEFZJCU01AVAIC.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcagtgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcgtcttcccctggcgcctgctccaggagcacctctgggggcacagcggtcccg

SEQ ID NO: 461102 - DNA, 546 bp, Homo sapiens
  misc_feature: HEFZJCU01EYRYU.52.49.E05.1.454.heavy.3.raw
cgcagtacgacacgaccggtgctcgatttagagcgactagcaacacacaaaggggacccaaaaaccacacccctccttgggagaatcccctagatcacagctcctcaccatggcctggacctggagcatccttttcttggtggcagcagcaacaggtgcccactcccaggttcacctggtgcagtcgggaggtgaggttaagaggcctggggcctcagtgaaggtcgcctgcaaggcttcaggttacaccctttccacgtctggtatcagttgggtgcgacaggcccccggacaagggcttgagtggatgggatggatcagcggtgacaacggcaacacaaattatggacagaagttccagggcagagtcaccatgaccgcggacacatccacgaacacagcctacatggagctgaggagcctaagatctgacgacacggccgtttattactgtgtgagagtatttagggacctcggcccttgggggagttatcgttactttgacttacgtggggccaggggaacccgaggtcacccggtctcccg

SEQ ID NO: 461103 - DNA, 530 bp, Homo sapiens
  misc_feature: HEFZJCU01ALDOE.48.33.C11.1.454.heavy.3.raw
agtatacatacacgaccggtgctcgatttagagtgagctcgttgggtttgggtgccgaagttgctggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttccccctggcgccctgctccaggagcacctcccgagaggcacagcggccctgggctgcctggtcaaggactactcctatgtatact

SEQ ID NO: 461104 - DNA, 510 bp, Homo sapiens; identical to SEQ ID NO: 448907
  misc_feature: HEFZJCU01EE34X.13.76.G10.1.454.heavy.3.raw

SEQ ID NO: 461105 - DNA, 402 bp, Homo sapiens; identical to SEQ ID NO: 444815
  misc_feature: HEFZJCU01EPB1A.11.70.G04.1.454.heavy.3.raw

SEQ ID NO: 461106 - DNA, 518 bp, Homo sapiens
  misc_feature: HEFZJCU01C9D7Q.17.33.C11.1.454.heavy.3.raw
  modified_base (496)..(496): a, c, t, g, unknown or other
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctcccgnagcctccaccaagggcccatcc

SEQ ID NO: 461107 - DNA, 354 bp, Homo sapiens
  misc_feature: HEFZJCU01DTB14.47.38.D05.1.454.heavy.3.raw
agctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtgggcaaagggaccacggtcaccgtctcctcagcctccaccaagggcccatcggtcttccccctggcaccctcctccaagagcacctctggggcacagcggccctgggctgcctggtcaaggactacttcctacgtgagct

SEQ ID NO: 461108 - DNA, 526 bp, Homo sapiens
  misc_feature: HEFZJCU01CJU2G.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactatacactgctccttttacacctccttgacttctggggccatggaacccggtccg

SEQ ID NO: 461109 - DNA, 512 bp, Homo sapiens
  misc_feature: HEFZJCU01AZW73.13.39.D06.1.454.heavy.3.raw
tcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactggagtggattgggcttatcaatgccaagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctggggccaaagggaccacggtcaccgtctcctcagcctccaccaacgggcccatcc

SEQ ID NO: 461110 - DNA, 496 bp, Homo sapiens
  misc_feature: HEFZJCU01DYMD7.4.19.B08.1.454.heavy.3.raw
agcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactctgggggaggcgtggtccagcctgggaggtccctgagactctcctgtatagcctctggattcaccttcggcagttatgctatgcactgggtccgccaggctccaggcaaggggttggagtgggtggcagcaatatcatatgatggaagtgataaatattacatagagtccgtgaagggtcgattcaccatctccagagacaatcgcaagaacacactgtatctggaaatgaccagcctgagaggtgacgacacgggtgttttattactgtgcgcgggatagaggctcatcgtggatacaa

SEQ ID NO: 461111 - DNA, 509 bp, Homo sapiens
  misc_feature: HEFZJCU01D0564.9.86.H09.1.454.heavy.3.raw
tgatacgtctcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatcggtcttccccctggccgccctgctccaggacg

SEQ ID NO: 461112 - DNA, 511 bp, Homo sapiens; identical to SEQ ID NO: 445840
  misc_feature: HEFZJCU01EDFRK.11.13.B02.1.454.heavy.3.raw

SEQ ID NO: 461113 - DNA, 503 bp, Homo sapiens
  misc_feature: HEFZJCU01CNBSM.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccgggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctgggggtggctacgagtactggtacttcgatctctggggccgtggcaccctgctgactgtctcctcagcctccaccaagggcccatcggtcttccccctggcgccctgctccaggagcacctccgagagcacagcggccctgggctgcctggtcaaggactacttccg

SEQ ID NO: 461114 - DNA, 521 bp, Homo sapiens
  misc_feature: HEFZJCU01CVMXK.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaatgaacaacctgagagccgacgacacggccgtttattactgtgcgagagattcgagtggttcggggacctcaccctggttctacttcgatctctggggcc

SEQ ID NO: 461115 - DNA, 444 bp, Homo sapiens
  misc_feature: HEFZJCU01BZ4U7.10.11.A11.1.454.heavy.3.raw
catagtagtgcacgaccggtgctcgatttagctacgactgcagggtgtacacctgtggttctcggggccgccggaaagggcccggagtggcttggtcggatctctctcactgggaacaccctatacaacccctctttcatgggtcgactctccctttcactggacctgtctgagaaccagttctccatgacactgacctctgtcatcgccgctgacacggccgtctatttctgcgcgtcctcatcccttattcatcatgatggttctacttattattacgagagatctgagttttgaccactggggccagggcatgctagtcaccgtctccccagcctccaccaagggcccatcggtcttccccctggcaccctcctccaagagcacctctgggggcacagcggccctgggctgcctggtcaaggactacttcccactactatg

SEQ ID NO: 461116 - DNA, 496 bp, Homo sapiens
  misc_feature: HEFZJCU01CVVUC.22.78.H01.1.454.heavy.3.raw
acatacgcgtcacgaccggtgctcgatttagtgtgagtagtttgggtttggggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggacggttcaccatctccagagacaactcccaggacactgtttatttagacatgaagagcctgcgcactgcggacacggccgtctatttctgtgtcaaagccagcgggcggatctacgatcctaacggctattactacggatttgacacctggggccagggaaccctggtcaccgtctcctcagcctccaccaagggcccatcggtcttccccctggcaccctcctccaagagcacctctgggggcacagcggcctgggctgcctggtcaaggactacttccacgcgtatgt

SEQ ID NO: 461117 - DNA, 500 bp, Homo sapiens; identical to SEQ ID NO: 446033
  misc_feature: HEFZJCU01DDVEP.11.27.C05.1.454.heavy.3.raw

SEQ ID NO: 461118 - DNA, 506 bp, Homo sapiens
  misc_feature: HEFZJCU01D5YPS.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaattgttttctgtcatccgtacaatttgaataggctctatggactggtacttcgtc

SEQ ID NO: 461119 - DNA, 514 bp, Homo sapiens
  misc_feature: HEFZJCU01AUXM5.13.21.B10.1.454.heavy.3.raw
tcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagcctggggggtccctgagactctcctgtcaagcctctgggttcagcttcagtgtatattggatgagctgggtccgccagactccagggaaggggctggagtgggtggccaacataaacacagacggaagtgacccatactatgcggactctgtgaagggccgattcaccatctccagagacaacgccaagaactcactatatttgcaaatggaccgcctgagagacgaggacacggctatgtattactgtgcgagagatgagagtggctacagttggggccggggaaccctggtcaccgtcaa

SEQ ID NO: 461120 - DNA, 491 bp, Homo sapiens
  misc_feature: HEFZJCU01ECJZX.11.13.B02.1.454.heavy.3.raw
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggcccgtgggctgcctggtcaggactacttccgtatctctcg

SEQ ID NO: 461121 - DNA, 520 bp, Homo sapiens; identical to SEQ ID NO: 446666
  misc_feature: HEFZJCU01BNKLL.7.78.H01.1.454.heavy.3.raw

SEQ ID NO: 461122 - DNA, 400 bp, Homo sapiens
  misc_feature: HEFZJCU01EFWYZ.4.60.F05.1.454.heavy.3.raw
agcactgtagcacgaccggtgctcgatttagtacgtcatcagggaaaggggctggagtgggtctccactattagtggtagtggtggtagtacatcctatgcagactccgtgaagggccgggttcaccatctccagagacaatgccaagaacacggtgtatgtgcaagtgaccagcctgagagtcgaggacacggccgtgtattactgtgcgaaggcctttgccccaaacgtggatatagtggctaactttagactactggggccagggaaccctggtcaccgtctcctcagcctccaccaagggcccatcggtcttccccctggcgccctgctccaggagcacctccgagagcacagcggccctgggctgcctggtcaaggactacttccctacagtgct

SEQ ID NO: 461123 - DNA, 517 bp, Homo sapiens
  misc_feature: HEFZJCU01D5W9M.13.10.A10.1.454.heavy.3.raw
tcacgtactacacgaccggtgctcgatttagcgtcgatctcagggtcttcgtggctcacgtccaccaccacgcatgtgacctcagggagtccctgagactctcctgtgaagcctcaacattcacttttgctcgtgcctgggtgacctgggtccgccaggctccagggaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgacccctgggcccgggaaccctggtcaccgtctcctcagcctccaccaagggcccatccggtcttccccctggcaccctcctcccagagcacctctgggggcacgagcggccctgggctgcctggtcaaggactacttcg

SEQ ID NO: 461124 - DNA, 498 bp, Homo sapiens
  misc_feature: HEFZJCU01CWBTS.12.2.A02.1.454.heavy.3.raw
atacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgagtggatgggatggatcagcgcttacaatggtaacacagactatgcacagaagttccaggacagagtcaccatgaccacagacacatccacgagcacagcctacatggagctgaggagcctgagatctgacgacacggccgtgtattactgtgcgagaggttttagtgatacttattgttagtgggtggtacctgctactttttc

SEQ ID NO: 461125 - DNA, 509 bp, Homo sapiens; identical to SEQ ID NO: 448615
  misc_feature: HEFZJCU01C80DP.7.28.C06.1.454.heavy.3.raw

SEQ ID NO: 461126 - DNA, 347 bp, Homo sapiens; identical to SEQ ID NO: 450801
  misc_feature: HEFZJCU01DI2QO.52.78.H01.1.454.heavy.3.raw

SEQ ID NO: 461127 - DNA, 500 bp, Homo sapiens
  misc_feature: HEFZJCU01DD15X.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgtttctgcaaatgaacagcctgagaattgaggactcgggtatatactactgtgcccgtgacccctgactgataaaccggactggttcgacccctggggccagggaaccctggtccaccgtctcct

SEQ ID NO: 461128 - DNA, 526 bp, Homo sapiens
  misc_feature: HEFZJCU01B7TIH.10.53.E09.1.454.heavy.3.raw
catagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccgaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcgtcgggggaataccttcagcactgggccagggcaccctggtcaccgtctcctcagcctccaccaagggcccatcggtccttcccctggccaccctcctccaagagcacctctggggcacagcc

SEQ ID NO: 461129 - DNA, 450 bp, Homo sapiens; identical to SEQ ID NO: 444890
  misc_feature: HEFZJCU01CMI09.9.53.E09.1.454.heavy.3.raw

SEQ ID NO: 461130 - DNA, 522 bp, Homo sapiens; identical to SEQ ID NO: 456832
  misc_feature: HEFZJCU01DAAKQ.9.78.H01.1.454.heavy.3.raw

SEQ ID NO: 461131 - DNA, 387 bp, Homo sapiens; identical to SEQ ID NO: 444930
  misc_feature: HEFZJCU01DWY2X.16.59.F04.1.454.heavy.3.raw

SEQ ID NO: 461132 - DNA, 469 bp, Homo sapiens
  misc_feature: HEFZJCU01BY12S.48.51.E07.1.454.heavy.3.raw
agtatacatacacgaccggtgctcgatttagcatactctacaacacacaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaaggagcccggggcctcagtgaaggtctcctgcaaggcttctggatacaccttcaccggctactatttgcactggctgcgacaggcccctggacaagggcttgagtggatgggatggatctatcctaccagtggtggcacacgctattcacagaagtttcagggcagggtcaccatgaccagggacacgtccatcagcacagcctacatggaattgagcaggctgacatctgacgacacggccgtgtattattgtgcgagag

SEQ ID NO: 461133 - DNA, 398 bp, Homo sapiens; identical to SEQ ID NO: 444524
  misc_feature: HEFZJCU01CDL27.7.60.F05.1.454.heavy.3.raw

SEQ ID NO: 461134 - DNA, 522 bp, Homo sapiens
  misc_feature: HEFZJCU01EFQTO.12.40.D07.1.454.heavy.3.raw
atacgacgtacacgaccggtgctcgatttagtgatagagcgtaacaacagagggctcaccatggagtttgggctgagcgtggtttcgtcgttaggctctttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcgggtcttcccctggcg

SEQ ID NO: 461135 - DNA, 384 bp, Homo sapiens; identical to SEQ ID NO: 444454
  misc_feature: HEFZJCU01DG31S.11.61.F06.1.454.heavy.3.raw

SEQ ID NO: 461136 - DNA, 535 bp, Homo sapiens
  misc_feature: HEFZJCU01CLMLE.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaaccaggtggtccttacaatgaccaccatggaccctgtggacacagccacatatttctgtgcacactctataggagcacctggtagtctgccaaactggttcgacccctggggcccgggaacccgtggtcaccgtctcctcagcctccaccaagggcccatcggtcttcccctc

SEQ ID NO: 461137 - DNA, 534 bp, Homo sapiens; identical to SEQ ID NO: 459052
  misc_feature: HEFZJCU01A6PAF.12.12.B01.1.454.heavy.3.raw

SEQ ID NO: 461138 - DNA, 518 bp, Homo sapiens; identical to SEQ ID NO: 444718
  misc_feature: HEFZJCU01BPRGS.9.34.D01.1.454.heavy.3.raw

SEQ ID NO: 461139 - DNA, 490 bp, Homo sapiens
  misc_feature: HEFZJCU01CSS1G.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctcaccaagggcccatcggtcttcccctggcacctcctccaacgagcacctctgggggcacagcggccctgggctgcctggtcaaggactacttccgagtgcgtct

SEQ ID NO: 461140 - DNA, 493 bp, Homo sapiens
  misc_feature: HEFZJCU01CCQ9U.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagtccgacgacacggcccactattattgtgcgagagagagaacattaaatttggcgggctactacgagaacggattgggcgcctggggccaagggaccacggtcatcgtctccgcagcctccaccaagggcccatcggtcttccccctggcaccctcctccaagagcacctctgggggcacagcggccctgggctgcctggtcaaggactacttccgagtgcgtct

SEQ ID NO: 461141 - DNA, 506 bp, Homo sapiens
  misc_feature: HEFZJCU01D08ZI.53.85.H08.1.454.heavy.3.raw
cgcgtatacacacgaccggtgctcgatttagtatcactcagtcgcgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcggggggacgcgtggtccagcctgggaggtccctgagactctcctgtgtagcctctggatttaccttcagggtctatgacatgcactgggtccgccaggctccaggcaaggggctggagtgggtggcacttatctcacatgatggaaataaaaaaactatggtgactccgtgaagggccgattctccgtctccagagacaattccaagaacaccttgtatctgcaatgaacagcctgagatatgaggacacggctctgtattactgtgcgaaagaaaaggttactgtggaagagtgggagttt

SEQ ID NO: 461142 - DNA, 513 bp, Homo sapiens
  misc_feature: HEFZJCU01CCVSQ.51.86.H09.1.454.heavy.3.raw
cgatcgtatacacgaccggtgctcgatttagtgctatagacttgggtttgggggaagaggaagactgacggtcctcccaggagttcaggtgcagctggtggactctgggggaggcgtggtccagcctgggaggtccctgagactctcctgtgcagcctctggattcacctttcaatacttatggcatgcactgggtccgccaggctccaggcaaggggctggagtggctgtcctttatctcatatgatggaggcaataaaattatgcagactccgtgaagggccgattcaccatctccagagacaattccaagaacactctatatttgcagatgaatagcctgagaattgaggacacggctgtgtattactgtgtgagagggtcggcatattccggtttttggagttaattatctactgggtaacttttgatatctggggccacgggacaatggtcaccgtctcttcagcttccaccaagggcccatcggtcttcccctggcgccctgctcca

SEQ ID NO: 461143 - DNA, 507 bp, Homo sapiens; identical to SEQ ID NO: 450163
  misc_feature: HEFZJCU01ATDJS.16.21.B10.1.454.heavy.3.raw

SEQ ID NO: 461144 - DNA, 546 bp, Homo sapiens
  misc_feature: HEFZJCU01EU69C.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggctttttcttgtggctttttaaaaggtgcccagtgtgaggtgcaactgttggagtctgggggaggcttggtacagccggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattactgtgcgaaggatcgcccctataatggtggttggagtcggggagtttggttcctggggccgagggaaccctggtctaccg

SEQ ID NO: 461145 - DNA, 512 bp, Homo sapiens
  misc_feature: HEFZJCU01EDJZL.51.12.B01.1.454.heavy.3.raw
cgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcaggggtcatcatgaccggggacacgtccatcgccacaacttacatggaactgaccagtctgacatttgacgacacggccgtctattactgtgcgacagaagcggcggacagaggttcgcttactggttcgaggctctcccccacg

SEQ ID NO: 461146 - DNA, 511 bp, Homo sapiens; identical to SEQ ID NO: 445871
  misc_feature: HEFZJCU01BY4ON.14.25.C03.1.454.heavy.3.raw

SEQ ID NO: 461147 - DNA, 519 bp, Homo sapiens; identical to SEQ ID NO: 446650
  misc_feature: HEFZJCU01AHMIU.13.76.G10.1.454.heavy.3.raw

SEQ ID NO: 461148 - DNA, 388 bp, Homo sapiens
  misc_feature: HEFZJCU01C1YM2.52.41.D08.1.454.heavy.3.raw
cgcagtacgacacgaccggtgctcgatttagtcacgcgagaaagggaaaggggctggaatgggtggcctttatttcatatgatggaaccaataaagcctacactgactccgtgaagggtcgattcaccatctcccgagacaattccaagaacacactctatctgcaaatgaacagcctgagacatgaggacacggctgtttactcttgtgcgagaattgccctctttagggggccctttgacaactggggccagggaaccctggtcaccgtctcctcagcctccaccaagggcccatcggtcttccccctggcaccctcctccaagagcacctctgggggcacagcggccctgggctgcctggtcaaggactacttcctatacgatcg

SEQ ID NO: 461149 - DNA, 541 bp, Homo sapiens
  misc_feature: HEFZJCU01CJBIY.12.85.H08.1.454.heavy.3.raw
atacgacgtacacgaccggtgctcgatttagtatcactcagtcgcgggaggtctgagagaggagcccagccctgggatttcaggtgtcctcatttggtgatcaggactgaacagagagaactcaccatggagtttgggctgagctggctttttcttgtggctttttaaaaggtgcccagtgtgaggtgcaactgttggagtctggggaggcttggtacagccggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattactgtgcgaaggatcgcccctataatggtggctggatcggggagtttgggttcctggggccaggggaaccctggtccg

SEQ ID NO: 461150 - DNA, 386 bp, Homo sapiens; identical to SEQ ID NO: 451684
  misc_feature: HEFZJCU01AL0HE.16.59.F04.1.454.heavy.3.raw

SEQ ID NO: 461151 - DNA, 324 bp, Homo sapiens; identical to SEQ ID NO: 444475
  misc_feature: HEFZJCU01AHUJC.18.17.B06.1.454.heavy.3.raw

SEQ ID NO: 461152 - DNA, 505 bp, Homo sapiens
  misc_feature: HEFZJCU01AZEJY.48.25.C03.1.454.heavy.3.raw
agtatacatacacgaccggtgctcgatttagtagtgtagatttgggtttggggagctctcagagaggtgccttagccctggattccaaggcatttccacttggtgatcagcactgaacacagaggactcaccatggagctggggctgtgctgggtcttccttgttgcttttttagaaggtgtccagtgtgaggtgcatctggtggagtctgggggagccttggtgcagcctggagagtccctaagactctcctgcgcagcctcaggattcagtttcagtagttatgaaatgaattgggtccgccaggctccagggaagggactggagtggctttcatatattactggcagtgggtctcttacccattatgcagactctgtgaggggccgattcaccatctccagagacaaccccgaaactctcttttctgcaaatggacagcctgacagccgacgatacggcctatttattactgtgcgagagatcgggacccccgcatatccaa

SEQ ID NO: 461153 - DNA, 509 bp, Homo sapiens
  misc_feature: HEFZJCU01D7GQL.9.78.H01.1.454.heavy.3.raw
tgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctcggcgccctgctccaggagcacctccgagagcacagcggccctgggctgcctggtcaaggactacttccagacgtatca

SEQ ID NO: 461154 - DNA, 497 bp, Homo sapiens
  misc_feature: HEFZJCU01BSPYN.4.75.G09.1.454.heavy.3.raw
  modified_base (481)..(481): a, c, t, g, unknown or other
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaacccaggtggtccttacaatgaccaacatggaccctgtggacacagccacatattactgtgcacagagatacgggcagcacgtggtttggggctactggggccagggaaccctggtcaccgtntcctcagcctccaccg

SEQ ID NO: 461155 - DNA, 531 bp, Homo sapiens
  misc_feature: HEFZJCU01DT2N3.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattggctactggggccagggaaccctggtcaccgtctcctcagcctccaccaaggg

SEQ ID NO: 461156 - DNA, 524 bp, Homo sapiens
  misc_feature: HEFZJCU01EKIDA.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtccttccccctggccgccctcgctccaggagcacctccgagacgcacagccggcccgtcgggcgtcg

SEQ ID NO: 461157 - DNA, 531 bp, Homo sapiens; identical to SEQ ID NO: 446857
  misc_feature: HEFZJCU01EQ8P8.7.78.H01.1.454.heavy.3.raw

SEQ ID NO: 461158 - DNA, 400 bp, Homo sapiens; identical to SEQ ID NO: 444452
  misc_feature: HEFZJCU01BDAEU.47.24.C02.1.454.heavy.3.raw

SEQ ID NO: 461159 - DNA, 400 bp, Homo sapiens; identical to SEQ ID NO: 444452
  misc_feature: HEFZJCU01B9TR3.47.24.C02.1.454.heavy.3.raw

SEQ ID NO: 461160 - DNA, 529 bp, Homo sapiens; identical to SEQ ID NO: 446480
  misc_feature: HEFZJCU01EXRST.18.33.C11.1.454.heavy.3.raw

SEQ ID NO: 461161 - DNA, 513 bp, Homo sapiens
  misc_feature: HEFZJCU01BV37W.40.44.D11.1.454.heavy.3.raw
tctagcgactcacgaccggtgctcgatttagcgcagtacgaagggggctttctgagagtcatggacctcctgcacaagaacatgaaacacctgtggttcttcctcctcctggtggcagctcccagatgggtcctgtcccaggtgcagctacagcagtggggcacaagactgttgaagccttcggagaccctgtccttcacctgcgctgtctatggtgggtccttcagtggttactactggacctggatccgccagcccccagggaaggggctggagtggattggggaaatcaatcatagtggaagcaccaactacaacccgtcactcaagagtcgactcaccatatcagtagacacgtccaagaaccagttctccctgaagctgagctctgtgaccgccgcggacacggctgtgtattactgtgcgagaggcttggtagcagtggctccggggcttttgactactgggccagggaccctggtcaccgtctcctcagcctccaccaacgggccc

SEQ ID NO: 461162 - DNA, 511 bp, Homo sapiens
  misc_feature: HEFZJCU01EHNUK.51.12.B01.1.454.heavy.3.raw
cgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcagggtcagtcatgaccggggacacgtccatcgccacaacttacatggaactgaccagtctgacatttgacgacacggccgtctattactgtgcgacagaagcggcggacagaggttcgcttactggttcgaggctctccccacg

SEQ ID NO: 461163 - DNA, 501 bp, Homo sapiens
  misc_feature: HEFZJCU01ECAEA.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaaacagcctgagagctgaggacacggctgtgtattactgtgcgaaagtatttctatagaggtgacgtacgggggcgttcg

SEQ ID NO: 461164 - DNA, 494 bp, Homo sapiens
  misc_feature: HEFZJCU01CXP07.10.71.G05.1.454.heavy.3.raw
catagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaatatactatggagactccttcaagggccgattcaccatctccagagacaattccaagaacatggtgtatctgcaaatgaccagcctgagagccgaggacacgggtgtttatactgtgggagaatcctagtggctac

SEQ ID NO: 461165 - DNA, 536 bp, Homo sapiens
  misc_feature: HEFZJCU01DTGBI.52.54.E10.1.454.heavy.3.raw
cgcagtacgacacgaccggtgctcgatttagatcgtagcagaacacacaaaggggacccaaaaaccacacccctccttgggagaatcccctagatcacagctcctcaccatggcctggacctggagcatccttttcttggtggcagcagcaacaggtgcccactcccaggttcacctggtgcagtcgggaggtgaggttaagaggcctggggcctcagtgaaggtcgcctgcaaggcttcaggttacaccctttccacgtctggtatcagttgggtgcgacaggcccccggacaagggcttgagtggatgggatggatcagcggtgacaacggcaacacaaattatggacagaagttccagggcagagtcaccatgaccgcggacacatccacgaacacagcctacatggagctgaggagcctaagatctgacgacacggccgtttattactgtgtgagagattttagggacctcggcccttgggggagttatcgttactttgactactggggccagggaacccaggtcaccgtct

SEQ ID NO: 461166 - DNA, 514 bp, Homo sapiens
  misc_feature: HEFZJCU01DFXXZ.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacgggtcatcgtctccgcagcctccaccaagggcccatcggtcttccccctggcaccctcctccaagagcacctctgggggcacagcggccctgggctgcctggtcaaggactacttccgagtgcgtct

SEQ ID NO: 461167 - DNA, 507 bp, Homo sapiens
  misc_feature: HEFZJCU01DNWH2.51.14.B03.1.454.heavy.3.raw
cgatcgtatacacgaccggtgctcgatttagtgtgagtagttccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcagggtcatcatgaccgggacacgtccatcgccacaacttacatggaactgaccagtctgacatttgacgacacggccgtctattactgtgcgacagaagcggcggacagaggttcgcttactggttcgaggctctcccca

SEQ ID NO: 461168 - DNA, 522 bp, Homo sapiens
  misc_feature: HEFZJCU01CRCGJ.7.78.H01.1.454.heavy.3.raw
  modified_base (304)..(304): a, c, t, g, unknown or other
cgtgtctctacacgaccggtgctcgatttagtgtgagtagtttgggtttgggattcacgttgcagctggtacagtctgggtctgaattgaggaagcctggggcggtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagntaaccaaccttcaacctgacgacactgccgtttatttttgtacgagagcgtcgtctgtcagtggaattgactacttgggggccagggaaccctggtcaccgtctcctcagcctccaccaagggcccatcggtcttcccctggcaccctcctccaagagcacctctgggggcacagcggccctgggctgcctggtcaaggactacttcctagagacacg

SEQ ID NO: 461169 - DNA, 523 bp, Homo sapiens
  misc_feature: HEFZJCU01BIRKN.53.76.G10.1.454.heavy.3.raw
cgcgtatacacacgaccggtgctcgatttagtcactcatacaggggttgggggcaacttataaacccaaaaggaatggccatgcagcgggtagggacaatacagacagatctcagcctgaaatggagcctcagggcacaggtgggcacggacactgtccacctaagccaggggcagacccgagtgtccccgcagtagacctgagagcgctgggcccacagcctcccctcggtgccctgctacctcctcaggtcaggcctggacatcccgggtttccccaggcctggcggtaggtttgggtgaggtctgtgtcactgtggtatgacgatttttggcgtggtttttccttcactattactcccactactacggtttggacgtctggggccaagggaccacggtcaccgtctcctcagcctccaccaagggcccatcggtcttcccctggcaccctcctccaagagcacctctgggggcacagcggccctgggctgcctggtcaaggactacttcctcgtactgcg

SEQ ID NO: 461170 - DNA, 513 bp, Homo sapiens
  misc_feature: HEFZJCU01CNAJE.11.72.G06.1.454.heavy.3.raw
cgagagataccacgaccggtgctcgatttagctacgactgcaaggggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcacactggaagcagagtctatgcggagagattccagggcagagtcaccctgaccacagagacatccacgaccacagtctacatggagctgtggagcctgagacctgacgacacggccctctattactgtgcgaggccctactcctacagtgaccactccacgcctggttcgacctcgtcggggccaacc

SEQ ID NO: 461171 - DNA, 519 bp, Homo sapiens; identical to SEQ ID NO: 444867
  misc_feature: HEFZJCU01D6SGS.9.34.D01.1.454.heavy.3.raw

SEQ ID NO: 461172 - DNA, 518 bp, Homo sapiens
  misc_feature: HEFZJCU01DN3PQ.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcggcctgggctgcctggtcaaggactacttccagacgtatca

SEQ ID NO: 461173 - DNA, 520 bp, Homo sapiens; identical to SEQ ID NO: 460246
  misc_feature: HEFZJCU01EMEPN.13.76.G10.1.454.heavy.3.raw

SEQ ID NO: 461174 - DNA, 493 bp, Homo sapiens; identical to SEQ ID NO: 449906
  misc_feature: HEFZJCU01CO8UJ.53.26.C04.1.454.heavy.3.raw

SEQ ID NO: 461175 - DNA, 489 bp, Homo sapiens; identical to SEQ ID NO: 444591
  misc_feature: HEFZJCU01BG81E.18.70.G04.1.454.heavy.3.raw

SEQ ID NO: 461176 - DNA, 517 bp, Homo sapiens
  misc_feature: HEFZJCU01COBOI.4.57.F02.1.454.heavy.3.raw
agcactgtagcacgaccggtgctcgattagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctcggcgccctcgctccacggagcacctctcggggcgacagcggccg

SEQ ID NO: 461177 - DNA, 519 bp, Homo sapiens
  misc_feature: HEFZJCU01EWRCR.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactcgtcctgtgcagcctctgggttcaccgtcagtcacacctacatgagctgggtccgccaggctccagggaaggggctggagtgcgtctcttttatttatagtagtggtagtacatactccgcagactccgtgagggggccgattcaccatctccagagacaattccaagaacacgctgtttcttcaaatgaacagcctgagagccgatgacacggccgtggtattactgtgcgagagatggggcccacgaacgtactacgctatggacgtcgtggggaccgg

SEQ ID NO: 461178 - DNA, 506 bp, Homo sapiens; identical to SEQ ID NO: 444696
  misc_feature: HEFZJCU01EQ2FU.16.34.D01.1.454.heavy.3.raw

SEQ ID NO: 461179 - DNA, 501 bp, Homo sapiens; identical to SEQ ID NO: 445027
  misc_feature: HEFZJCU01BZ3SG.26.23.C01.1.454.heavy.3.raw

SEQ ID NO: 461180 - DNA, 324 bp, Homo sapiens
  misc_feature: HEFZJCU01CTPV9.18.17.B06.1.454.heavy.3.raw
tacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccacttttgactattggggccagggagccctggtcaccgtctcctcagcctccaccaagggcccatcggtcttccccctggcgccctgctccaggagcacctccgagagcacagcggccctgggctgcctggtcaaggactacttcccataccgta

SEQ ID NO: 461181 - DNA, 497 bp, Homo sapiens
  misc_feature: HEFZJCU01AGUF2.51.25.C03.1.454.heavy.3.raw
cgatcgtatacacgaccggtgctcgatttagtagtgtagatttgggtttgggggggaaatactttctgagagtccaggacctcctgtgcaagaacatgaaacacctgtggttcttcctcctgctggtggcagctcccagatgggtcctgtcccagctgcagctacaggagtccggctcaggactggtgaagccttcacagaccctgtccctcacctgcgctgtctctggtggctccatcggcagtgctgattactcctggagctggatccggcagtcaccagggaagggcctggagtggattgggtatatctatgatagtgggagcgcctactacaacccgtccctcaagaggcgagtcaccatatctctagacaggtccaagaaacagttctccctgaagctgagctctgtgaccgccgcggacacggccgtctattactgtgccagacgagttgtcgtagtcccagctgatgtcgattattattactattatgct

SEQ ID NO: 461182 - DNA, 521 bp, Homo sapiens
  misc_feature: HEFZJCU01DTC0A.48.65.F10.1.454.heavy.3.raw
agtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctttctatggtgggtccttcagtggttactactggagctggatccgccagcccccagggaaggggctggagtggattggggaaatcaatcatagtggaagcaccaactacaacccgtccctcaggagtcgagtcaccatatcagtagacacgtccaagaaccagttctccctgaagctgagctctgtgaccgccgcggacacggctgtgtattactgtgcgagagcggatattgtagtagtaccagctgctatttttgccggtggttcgaccctggggccagggaaccctggtcaccgtctcctcagcctccaccg

SEQ ID NO: 461183 - DNA, 462 bp, Homo sapiens
  misc_feature: HEFZJCU01A0MSV.53.12.B01.1.454.heavy.3.raw
cgcgtatacacacgaccggtgctcgatttagtagtgtagattccgcgggcaccttgaccaactactatttacagtggttgcgacaggtccctggacaagggcttgagtggatgggaagaatcaaccctaatgatggaagtgcaacaaatgcgctgaaatttcagggcagaataaccctgaccagggacacgtccacgagcacagtctacatggaattgagcagcctaacatctgaagacacggccgtctattactgtgcgagagaatatcgttttatagtgggagctgccccaagatcgccattccactttgactactggggccagggaacactggtcaccgtctcctcagcctccaccaagggcccatcggtccttccccctggccaccctcctccaagagcacctctgggggcacagcggccctgggctgcctggtcaaggactacttcctcgtactgcg

SEQ ID NO: 461184 - DNA, 532 bp, Homo sapiens
  misc_feature: HEFZJCU01DJIXW.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgattctgagaagtgaggacacggctgtttattactgtgcgcggtgctgaccgcttcttgactacgtgggggcccggggagccccgggtcatcgtctcc

SEQ ID NO: 461185 - DNA, 516 bp, Homo sapiens; identical to SEQ ID NO: 457880
  misc_feature: HEFZJCU01DV0X7.51.26.C04.1.454.heavy.3.raw

SEQ ID NO: 461186 - DNA, 509 bp, Homo sapiens; identical to SEQ ID NO: 447939
  misc_feature: HEFZJCU01B5HPH.17.25.C03.1.454.heavy.3.raw

SEQ ID NO: 461187 - DNA, 528 bp, Homo sapiens
  misc_feature: HEFZJCU01CSOMA.13.26.C04.1.454.heavy.3.raw
tcacgtactacacgaccggtgctcgatttagtctagcgactttgggtttgggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggacggtttttggggcgcggactcctcttgagatctggggccagggggacaatggtcaccgtctcttca

SEQ ID NO: 461188 - DNA, 507 bp, Homo sapiens
  misc_feature: HEFZJCU01CTGG1.47.48.E04.1.454.heavy.3.raw
agctcacgtacacgaccggtgctcgatttagagagcgtcacagagagaaggggctcagagaggagccttagccctggactccaaggcctttccacttggtgatcagcactgagcacagaggactcaccatggaattggggctgagcagggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccagggaaggggctggagtgggttggcaacataaatccagatggaagtcagaaaacctatgtggactctctgaagggccgattcaccatctccagagacaacgccaagaactctctgtttctgcaaatggacagcctgagagtcgaagacacggctgtgtattactgtgtgtctctgacgcctcggccggaccttggcttcg

SEQ ID NO: 461189 - DNA, 384 bp, Homo sapiens; identical to SEQ ID NO: 444454
  misc_feature: HEFZJCU01D9JX2.11.61.F06.1.454.heavy.3.raw

SEQ ID NO: 461190 - DNA, 530 bp, Homo sapiens
  misc_feature: HEFZJCU01BR7AV.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagaccgacacggctgtctattattgcgcgagagagacacacgaacctactggccaatactatgggggcttggttctgggggccgaggggaccctggtcatcgtcctccccacgcctccaccaacgggcccatcggtcttccccctggccg

SEQ ID NO: 461191 - DNA, 427 bp, Homo sapiens; identical to SEQ ID NO: 444708
  misc_feature: HEFZJCU01A8W28.9.34.D01.1.454.heavy.3.raw

SEQ ID NO: 461192 - DNA, 463 bp, Homo sapiens; identical to SEQ ID NO: 459359
  misc_feature: HEFZJCU01B2FVW.19.10.A10.1.454.heavy.3.raw

SEQ ID NO: 461193 - DNA, 532 bp, Homo sapiens
  misc_feature: HEFZJCU01BKM6E.21.78.H01.1.454.heavy.3.raw
tcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcactttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctggggccggggaacccgtggtcaccgtctccccaccctccaccaac

SEQ ID NO: 461194 - DNA, 523 bp, Homo sapiens
  misc_feature: HEFZJCU01EYR6C.53.78.H01.1.454.heavy.3.raw
cgcgtatacacacgaccggtgctcgatttagtgtgagtagtttgggtttgggggagcatcacataacaaccagattcctcctctaaagaagcccctgggagcacagctcatcaccatggactggacctggaggttcctctttgtggtggcagcagttacaggtgtccagtcccaggtccagttggtgcagtctggggctgagttgaagaagcctgggtcctcggtgaaggtctcctgcaagtattctggaggcaccttcaacaactatggtatcagctgggtgcgacaggcccctggacaagggcttgagtggatgggaagggtcacccctatttttgatgaagcagactctgcacagaagttccagggcagattaacgattacggcggacaagtccacgactaccgcctacatggagctgaccagtctgaaatctgaggacacggccctttattactgtgcgagatataccgtgggggttacggcggagatatcgccatactacttcactactggggccaac

SEQ ID NO: 461195 - DNA, 499 bp, Homo sapiens
  misc_feature: HEFZJCU01EBR5L.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagctgagagctgaggacacggctgtgtattactgtgcgaaagtatttctatagaggtgacgtac

SEQ ID NO: 461196 - DNA, 509 bp, Homo sapiens
  misc_feature: HEFZJCU01BXBGF.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctgggggggggctggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtacttacg

SEQ ID NO: 461197 - DNA, 379 bp, Homo sapiens; identical to SEQ ID NO: 444450
  misc_feature: HEFZJCU01BO9NN.47.77.G11.1.454.heavy.3.raw

SEQ ID NO: 461198 - DNA, 499 bp, Homo sapiens
  misc_feature: HEFZJCU01AYNUU.14.25.C03.1.454.heavy.3.raw
cgtctagtaccacgaccggtgctcgatttagtagtgtagatttgggtttgggggggaggacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggaggagatgggaggtcgatattgta

SEQ ID NO: 461199 - DNA, 523 bp, Homo sapiens
  misc_feature: HEFZJCU01DYYD7.47.64.F09.1.454.heavy.3.raw
agctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcaccagttttaattattggtggggctggatccgccagcccccagggaaggggctggaatggattgggagtatattttataatggggacactctttacaacccatccctcaagagtcgagtttccatatccgcagacacgtccgagaatcacttctccctgaaactgagctctgtgaccgccgcagacacggctgtttattactgttcgagacatgccgaccgagagcattatcggcagtacggttttgattagtttggggccaagggacaaggggtcaccgtctccgcagcctccaccg

SEQ ID NO: 461200 - DNA, 427 bp, Homo sapiens; identical to SEQ ID NO: 444708
  misc_feature: HEFZJCU01CGFGU.9.34.D01.1.454.heavy.3.raw

SEQ ID NO: 461201 - DNA, 536 bp, Homo sapiens
  misc_feature: HEFZJCU01EB22Y.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactggctcggccctcggggcccgggaacccgtggtcaccgtctcctcagcctccaccaagggcccatcggtcttcccctggcaccctcctccagacg

SEQ ID NO: 461202 - DNA, 493 bp, Homo sapiens
  misc_feature: HEFZJCU01EBX63.52.37.D04.1.454.heavy.3.raw
cgcagtacgacacgaccggtgctcgatttagtagcatactgttgggtttgggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctggggggggctggtccagcctgggaggtccctgagactctcctgtgcaggctctgcatttcccttcagtaactatgctatcgattgggtccgccaggctccaggcaagggactggagtgggtggcagttatatcagctgatggaggcagtaaatattacgcagattctgcgaggggccgattcaccatatccagagacaactcccaagatatgatatatctacaaatagaacagcctgagacctgaggacgacggctgtatattattgtgcgtcgagggggcagt

SEQ ID NO: 461203 - DNA, 508 bp, Homo sapiens
  misc_feature: HEFZJCU01CTBQT.13.37.D04.1.454.heavy.3.raw
tcacgtactacacgaccggtgctcgatttagtagcatactgttgggtttgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattgtaatgatggtagctgctactacactttttgactactggggccagggaaccctggtcaccgtctcttcagcctccaccaagggcccatcggtcttccccgtggtcaccctcctccaagagcacctctgggggcacagcggcctggctgcctggtcaagggactacttcctagtaccgtga

SEQ ID NO: 461204 - DNA, 459 bp, Homo sapiens; identical to SEQ ID NO: 458502
  misc_feature: HEFZJCU01D6TD6.53.12.B01.1.454.heavy.3.raw

SEQ ID NO: 461205 - DNA, 487 bp, Homo sapiens; identical to SEQ ID NO: 452507
  misc_feature: HEFZJCU01AY9J5.51.52.E08.1.454.heavy.3.raw

SEQ ID NO: 461206 - DNA, 316 bp, Homo sapiens; identical to SEQ ID NO: 444444
  misc_feature: HEFZJCU01DZSVP.47.56.F01.1.454.heavy.3.raw

SEQ ID NO: 461207 - DNA, 498 bp, Homo sapiens
  misc_feature: HEFZJCU01CK2IQ.4.75.G09.1.454.heavy.3.raw
  modified_base (486)..(486): a, c, t, g, unknown or other
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctaccaaaaaccaggtggtccttacaatgaccaacatggaccctgtggacacagccacatattactgtgcacagagatacgggcagcacgtggtttggggctactggggccagggaaccctggtcaccgtctcctnacgcctccaccg

SEQ ID NO: 461208 - DNA, 529 bp, Homo sapiens; identical to SEQ ID NO: 455700
  misc_feature: HEFZJCU01A2H9T.14.35.D02.1.454.heavy.3.raw

SEQ ID NO: 461209 - DNA, 386 bp, Homo sapiens; identical to SEQ ID NO: 446054
  misc_feature: HEFZJCU01CXFNG.18.60.F05.1.454.heavy.3.raw

SEQ ID NO: 461210 - DNA, 507 bp, Homo sapiens
  misc_feature: HEFZJCU01CI60Z.47.48.E04.1.454.heavy.3.raw
agctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtacaatctgggggaggcttggtccagcctggggggtccctcagactctcctgtgcagcctctggattcacctttagttcctcttggatgaattgggtccgccagactccagggaaggggctggagtgggttggcaacataaatccagatggaagtcagaaaacctatgtggactctctgaagggccgattcaccatctccagagacaacgccaagaactctctgtttctgcaaatggacagcctgagagtcgaagacacggctgtgtattactgtgtgtctctgcgcctcggccggaccttggcttctc

SEQ ID NO: 461211 - DNA, 515 bp, Homo sapiens
  misc_feature: HEFZJCU01BATBZ.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtcctttgaccagtggggccagggaaccctggtcaccgtctcctcagcttccaccaagggcccatcggtcttcccctggcgccctgctccaggagcacctctgggggcacagcggtcccg

SEQ ID NO: 461212 - DNA, 507 bp, Homo sapiens
  misc_feature: HEFZJCU01DBE6J.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaagggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgtttcgatgccttcggtccgcggacttctggggccagggaacctc

SEQ ID NO: 461213 - DNA, 505 bp, Homo sapiens
  misc_feature: HEFZJCU01A3S28.48.23.C01.1.454.heavy.3.raw
agtatacatacacgaccggtgctcgatttagtacacgtgattagggattggggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtggggccaagggacaatggtcaccgtctcttcagcctccaccaa

SEQ ID NO: 461214 - DNA, 479 bp, Homo sapiens; identical to SEQ ID NO: 447128
  misc_feature: HEFZJCU01B5KZ6.4.37.D04.1.454.heavy.3.raw

SEQ ID NO: 461215 - DNA, 485 bp, Homo sapiens
  misc_feature: HEFZJCU01AVABF.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacagggtgtttctccaagtgattgatctgagaagtgaggacacggctgtttattactgtgcgcggtggctgaccgctcttgactactggggccggggagccccggtcatcgtctcctcagcctccaccaagggcccatcggtcttccccctggcaccctcctccaagagcacctctgggggcacagcggccctgggctgcctggtcaaggactacttccgagtagtaca

SEQ ID NO: 461216 - DNA, 511 bp, Homo sapiens; identical to SEQ ID NO: 446675
  misc_feature: HEFZJCU01CUX87.4.23.C01.1.454.heavy.3.raw

SEQ ID NO: 461217 - DNA, 505 bp, Homo sapiens; identical to SEQ ID NO: 447076
  misc_feature: HEFZJCU01BIM8U.10.38.D05.1.454.heavy.3.raw

SEQ ID NO: 461218 - DNA, 481 bp, Homo sapiens
  misc_feature: HEFZJCU01DP61B.16.71.G05.1.454.heavy.3.raw
tgtactactccacgaccggtgctcgatttagtgtcgtcgcaagagagaggggtccctgagactctcctgtgcagcctctggattcacctttgacagctatgccatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctggcaccctcctccaagagcacctctggggcacagcggccctgggctgcctggtcaaggactacttccgagtagtaca

SEQ ID NO: 461219 - DNA, 507 bp, Homo sapiens
  misc_feature: HEFZJCU01C33P9.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctaccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttcccctggcgccctgctccaggagcacctccgagagcacagcgccctgggctgcctggtcaaggactactccgagtgcgtct

SEQ ID NO: 461220 - DNA, 383 bp, Homo sapiens; identical to SEQ ID NO: 444477
  misc_feature: HEFZJCU01C5KOM.47.60.F05.1.454.heavy.3.raw

SEQ ID NO: 461221 - DNA, 501 bp, Homo sapiens; identical to SEQ ID NO: 453820
  misc_feature: HEFZJCU01DMEFA.3.20.B09.1.454.heavy.3.raw

SEQ ID NO: 461222 - DNA, 489 bp, Homo sapiens; identical to SEQ ID NO: 444791
  misc_feature: HEFZJCU01EEXIV.47.85.H08.1.454.heavy.3.raw

SEQ ID NO: 461223 - DNA, 520 bp, Homo sapiens
  misc_feature: HEFZJCU01BFARX.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactcgtggtcaccgtctccgcagcctccaccaacgggcccagtcc

SEQ ID NO: 461224 - DNA, 516 bp, Homo sapiens
  misc_feature: HEFZJCU01B8QEJ.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccgagcgggagttccaagtactcctttgacgtctggggcc

SEQ ID NO: 461225 - DNA, 518 bp, Homo sapiens; identical to SEQ ID NO: 445810
  misc_feature: HEFZJCU01EWVGV.2.11.A11.1.454.heavy.3.raw

SEQ ID NO: 461226 - DNA, 390 bp, Homo sapiens
  misc_feature: HEFZJCU01CMYSH.16.29.C07.1.454.heavy.3.raw
tgtactactccacgaccggtgctcgatttagagtgctacgaagggaaaggggctggagtgggtctcagctattagtattagtggtgatagcacatactacgcagactccgtgaagggccggttcaccatctccagagacaattccaagaatacactgtatctgcgaatgaatggcctgagagccgaagacacggccgtctactactgtgcgaaagaagggcgtgggagttacttatatggtgatatgtggggccaagggacaatggtcaccgtctcttcagcctccaccaagggcccatcggtcttccccctggcgccctgctccaggagcacctccgagagcacagcggccctgggctgcctggtcaaggactacttccgagtagtaca

SEQ ID NO: 461227 - DNA, 513 bp, Homo sapiens; identical to SEQ ID NO: 446452
  misc_feature: HEFZJCU01CW4IP.17.33.C11.1.454.heavy.3.raw

SEQ ID NO: 461228 - DNA, 532 bp, Homo sapiens
  misc_feature: HEFZJCU01BWI9E.53.64.F09.1.454.heavy.3.raw
cgcgtatacacacgaccggtgctcgatttagcgcgtatacaagggggagagaggagcccagccctgggattttcaggtgttttcatgtggtgatcaggactgaacagagagaactcaccatggagtctgggctgacgtggctttttcttgtggctattttaaaaggtgtccagtgcgacgtgcagctggtggagtcggggggaggcttggtacagccgggggggtccctgagactctcctgtagagtctctggcttcacctttggagtctatgacatgagttgggtccgccaggctccggggaagggctggagtgggtctcaacgatcagtgatagcggaagtaccacaaactacgccgcctccgtgaagggccatgcaccgtctccagagacaattcgaaggacactttatatctgcaactcaacagactgacaaccgctgacacggccgtctattactgtgtcaaagaagaccggaccgctggacgaggagccaggaggaaaatcaactactttgactacgtggggccaa

SEQ ID NO: 461229 - DNA, 539 bp, Homo sapiens
  misc_feature: HEFZJCU01D2DGD.22.34.D01.1.454.heavy.3.raw
acatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactcccaccctccctcaagagtcgagccaccatatcagtcgacacgtccaagaaccagttctccctgaaactgaggtctgtgaccgcagcggacacggccgtgtattactgtgcgagagagtccgggtccgatatctggccgttcgacccctggggccagggaaccctggtcaccgtctcctcagcctccaccaagggcccatcggtcttcccctggcgccctgctccaggagcacctccgagagcacagcggccctgggctgcctggtcaaggactacttccaccg

SEQ ID NO: 461230 - DNA, 504 bp, Homo sapiens
  misc_feature: HEFZJCU01ACQ9N.47.48.E04.1.454.heavy.3.raw
agctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctggggaggcttggtccagcctggggggtccctcagactctcctgtgcagcctctggattcacctttagttcctcttggatgaattgggtccgccagactccagggaagggctggagtgggttggcaacataaatccagatggaagtcagaaacctatagtggactctctgaagggccgattcaccatctccagagacaacgccaagaactctctgtttctgcaaatggacagcctgagagtcgaagacacggctgtgtattactgtgtgtctctgacgcctcgccggaccttggcttcg

SEQ ID NO: 461231 - DNA, 484 bp, Homo sapiens; identical to SEQ ID NO: 446564
  misc_feature: HEFZJCU01B7YBM.19.13.B02.1.454.heavy.3.raw

SEQ ID NO: 461232 - DNA, 508 bp, Homo sapiens; identical to SEQ ID NO: 446002
  misc_feature: HEFZJCU01D8OXA.9.78.H01.1.454.heavy.3.raw

SEQ ID NO: 461233 - DNA, 514 bp, Homo sapiens
  misc_feature: HEFZJCU01CFOGR.13.55.E11.1.454.heavy.3.raw
tcacgtactacacgaccggtgctcgatttagcactcgcacgttgggtttgggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtctgggggaggcttggtaaagccgggggggtcccttcgactctcctgtgcagcctctggaatcactttcagtgacgcctggatgaactgggtccgccaggctccagggaaggggctggagtggattggccgtattaaaagtgagcctgatggtgggacaacagactacgctgcacccgtgaagggcagattcaccatctccagagatgattcaaggaacacagtgtttctgcaatgaacagcctgactgccggggacactgccgtgtattactgtgccagcagcagtacctggccactactattttttgacttctc

SEQ ID NO: 461234 - DNA, 493 bp, Homo sapiens; identical to SEQ ID NO: 455531
  misc_feature: HEFZJCU01AUXQA.47.85.H08.1.454.heavy.3.raw

SEQ ID NO: 461235 - DNA, 506 bp, Homo sapiens
  misc_feature: HEFZJCU01AEMO4.51.72.G06.1.454.heavy.3.raw
cgatcgtatacacgaccggtgctcgatttagctacgactgcaagggaaagggggctctgggagaggagcccagcactagaagtcggcggtgtttccattcggtgatcagcactgaacacagaggactcaccatggagtttgggctgacctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatttcatatgatggaagtaaaatattctatgtagactccgtgaagggccgcttcatcatctccagagacaattcccagaacaccctgtttctgcaaatgcacagcctgagacctgaggacacggctgtgtattactgtgcgaacttaatcacggaggacaacggtccg

SEQ ID NO: 461236 - DNA, 519 bp, Homo sapiens
  misc_feature: HEFZJCU01DWOLW.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgtctggggccaggggaccctggtcatcgtctccccagcctccaccaagggcccatcggtcttcccctggc

SEQ ID NO: 461237 - DNA, 527 bp, Homo sapiens
  misc_feature: HEFZJCU01CIKOH.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggccaagggaccacggtcaccgtctcctcagcctccaccaagggcccatcggtcttcccctggcgccctgctccaggagcacctccgagagcacagcggccctgggctgtccg

SEQ ID NO: 461238 - DNA, 490 bp, Homo sapiens
  misc_feature: HEFZJCU01COH7N.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctccgacgagcacagcggccctgggctgcctggtcaaggactacttcctacgtgagct

SEQ ID NO: 461239 - DNA, 526 bp, Homo sapiens
  misc_feature: HEFZJCU01CLZOF.3.55.E11.1.454.heavy.3.raw
agacgcactccacgaccggtgctcgatttagcactcgcacgttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagatatgctatgtattgggtccgtcaggctccaggcaaggggctggagtgggtggcagttatgtcacatgatggaagaaaaaaatattacgcagactccctgaagggtcgattcaccatctccagagacaattccaacaacacccctgtatttgcaaatgaacagcctgagaactgaagacacggctatctattactgtgcgagagatcagtccggacgacgaaatgactacggtggtaaaccttccagactactggggccagggaaccctggtcaccgtctcctcagcctccaccaaggcccatcggtccttcccctggccaccctcctccaacgacg

SEQ ID NO: 461240 - DNA, 529 bp, Homo sapiens
  misc_feature: HEFZJCU01EDILS.49.39.D06.1.454.heavy.3.raw
agtcgagagacacgaccggtgctcgatttagtgacatctcgcagttctttgggttttcctcgttgctcttttaagaggtgtccagtgtcaggtgcaactggtggagtctgggggaggcgtggtccagcctgggaggtccctgagactctcctgtgcagcctctggatttaccttcagcagctatgctatgcactggttccgccaggctccaggcaaggggctggagtgggtggcagttatttcatatgatggaagcgataaatactacgcagactccgtgaagggccgagtcaccatctccagacacaattccaagaacacggtgtttctgctggtgaacagcctgagaactgaggacacggctgtgtattactgtgcggcaggcaacgattactacccgaaggactacgtggggccgagggaacccgtggtcaccgtctcctcagcctccaccaacgggcccatcggtccttcccctcggccaccctcctccaacgacgcacctcgtcgggggcacagccggcccgtc

SEQ ID NO: 461241 - DNA, 520 bp, Homo sapiens
  misc_feature: HEFZJCU01D2H3D.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctcggcgccctgctccaggagcacctccgacgagcacacgcggcccgtcgggctcg

SEQ ID NO: 461242 - DNA, 501 bp, Homo sapiens; identical to SEQ ID NO: 447719
  misc_feature: HEFZJCU01A5A16.17.10.A10.1.454.heavy.3.raw

SEQ ID NO: 461243 - DNA, 525 bp, Homo sapiens
  misc_feature: HEFZJCU01AXANE.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatgggtctcagttattcataccgacggtaccatatatgacgcagactccgtgaagggccgattcaccatctccagagaccattccaagaacaccctatatcttcaaatgaacaacctgagagtcgaagacacggccgtatattactgtgcgagacatgacttcggtgaccccgtggggccaggggaaccctgggtccaccggtctcctcacg

SEQ ID NO: 461244 - DNA, 498 bp, Homo sapiens
  misc_feature: HEFZJCU01C3GZB.12.14.B03.1.454.heavy.3.raw
atacgacgtacacgaccggtgctcgatttagtgtgagtagttccgcgggggggggaggcttggttcggcctggcgggtccctgagactctcctgcgcagcctctggattcctttttgaggattttgccatgcactgggtccggcaagctccggggaggggcctggagtgggtctcaacaattacttggaatagtgctaccatagcctacacagactccgtgaagggccgattcatcacttctagagacaacgccgagaactccctgtatctgcagatgaacagtctgagacctgaggacacggccctgtatttctgttcaaaaggggctctggttcagggatggggctttgactcctgggcccagggaaccctggtcgcggtctcctcagcctccaccaagggcccatcggtcttcccctggcaccctcctccaagagcacctctgggggcacagcggccctgggctgcctggtcaaggactacttcctacgtcgtat

SEQ ID NO: 461245 - DNA, 497 bp, Homo sapiens; identical to SEQ ID NO: 445179
  misc_feature: HEFZJCU01EZOJE.12.55.E11.1.454.heavy.3.raw

SEQ ID NO: 461246 - DNA, 495 bp, Homo sapiens; identical to SEQ ID NO: 445359
  misc_feature: HEFZJCU01DQBHM.4.21.B10.1.454.heavy.3.raw

SEQ ID NO: 461247 - DNA, 508 bp, Homo sapiens
  misc_feature: HEFZJCU01CLVCE.2.33.C11.1.454.heavy.3.raw
acgctcgacacacgaccggtgctcgatttagagtgagctcgttgggtttggggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaagtaagactgctggtgagacaacagactacgctgctgccttcagaggcagattcaccatcttcagagatgaatcacagagcactctgtttctgcaatgaacagcctggaagacgcggacacagccatgtattattgtacattaggacactatagtccctggggccagggaaccctcg

SEQ ID NO: 461248 - DNA, 515 bp, Homo sapiens
  misc_feature: HEFZJCU01CPK0Z.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagataaccgtcgcctggttatta

SEQ ID NO: 461249 - DNA, 515 bp, Homo sapiens
  misc_feature: HEFZJCU01DSGBF.53.10.A10.1.454.heavy.3.raw
cgcgtatacacacgaccggtgctcgatttagcgtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgccctccaggggggacctttggggtttcgaccccgtggggccagggaaccctggtcaccggtctcctcagcctccaccaagggcccatccggtcttcccctggcaccctcctccagacgcacctc

SEQ ID NO: 461250 - DNA, 400 bp, Homo sapiens; identical to SEQ ID NO: 444452
  misc_feature: HEFZJCU01DDITF.47.24.C02.1.454.heavy.3.raw

SEQ ID NO: 461251 - DNA, 497 bp, Homo sapiens
  misc_feature: HEFZJCU01DB18P.16.37.D04.1.454.heavy.3.raw
tgtactactccacgaccggtgctcgatttagtagcatactgtgggtttggggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 461252 - DNA, 502 bp, Homo sapiens; identical to SEQ ID NO: 450016
  misc_feature: HEFZJCU01AUVJ2.17.10.A10.1.454.heavy.3.raw

SEQ ID NO: 461253 - DNA, 518 bp, Homo sapiens
  misc_feature: HEFZJCU01AJ2NC.14.66.F11.1.454.heavy.3.raw
cgtctagtaccacgaccggtgctcgatttagtcacgcgagaagggtgccagggggaagaccgatgggcccaggactggtgaagccttcggagaccctgtccctcacctgcactgtctctggcggctccatcaatacttacaactggacctggatccggcagcccccagggaagggtctgaattggattgggtatatctctaacagtgggaggaccaactacaacccctccctccagagtcgagtcaccatttcattagacacgtccaagaaccagttctccctgaggttgaactctgtgaccgctgcggacacggccgtgtattattgtgcgaggtcggtggccacaatggcgagtacaactggttcgaccccctggggccagggaaccctggtcaccgtctcctcagcctccaccaagggcccatcggtcttccccctggcaccctcctcccaagagcacctctgggggcacagcggccctgggctgcctggtcaaggactacttccgtactagacg

SEQ ID NO: 461254 - DNA, 379 bp, Homo sapiens; identical to SEQ ID NO: 444450
  misc_feature: HEFZJCU01CBMH0.47.77.G11.1.454.heavy.3.raw

SEQ ID NO: 461255 - DNA, 519 bp, Homo sapiens
  misc_feature: HEFZJCU01C94IR.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggatgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccgagcggggagttccgaagtactcctttgacgtctggggccac

SEQ ID NO: 461256 - DNA, 512 bp, Homo sapiens
  misc_feature: HEFZJCU01EDO0R.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaacctggtcgccgtctcctcagcctccaccaaggcccatcggtcttcccctgcaccctcctccaagagcacctctgggggcacagcgccctgggctgcctggtcaaggactactccagacgtatca

SEQ ID NO: 461257 - DNA, 512 bp, Homo sapiens; identical to SEQ ID NO: 452727
  misc_feature: HEFZJCU01BE7YY.16.21.B10.1.454.heavy.3.raw

SEQ ID NO: 461258 - DNA, 502 bp, Homo sapiens
  misc_feature: HEFZJCU01AZHZT.13.33.C11.1.454.heavy.3.raw
tcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgtcacaaagtttgcacagaactttcaggacagggtcaccatgaccacggacacgtccatcaacacagcctacatggaactgaggagcctaagatctgacgacacggccgtttattattgtgcaatagaattgcaaacgatgcttttgatatgtgggccaagggactacg

SEQ ID NO: 461259 - DNA, 482 bp, Homo sapiens
  misc_feature: HEFZJCU01EJBI6.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtctcccctggcgccctgctccaggagcacctccgagagcacagcggccctgggctgcctggtcaaggactacttcccactactatg

SEQ ID NO: 461260 - DNA, 349 bp, Homo sapiens
  misc_feature: HEFZJCU01E0XNO.13.23.C01.1.454.heavy.3.raw
tcacgtactacacgaccggtgctcgatttagtacacgtgattagggattgggcttatcaatgccagtgggggcaccagctacaacccctccctcaagagccgcgtcaccatttcagtagacgtccaagaaccagctctccctgaagctgagttctgtgaccgccgcagacacggccgtgtattactgtgcgcgacaggtggacgtctggggccaagggaccacggtcaccgtctcctcagcctccaccaagggcccatcggtcttccccctggcgccctgctccaggagcacctccgagagcacagcggccctgggctgcctggtcaaggactacttcctagtacgtga

SEQ ID NO: 461261 - DNA, 515 bp, Homo sapiens; identical to SEQ ID NO: 451390
  misc_feature: HEFZJCU01BX9DC.16.2.A02.1.454.heavy.3.raw

SEQ ID NO: 461262 - DNA, 517 bp, Homo sapiens
  misc_feature: HEFZJCU01AT4ZP.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtccttcccctggcgccctgcctccaggagcacctccgagagcacagcggccctgggctcg

SEQ ID NO: 461263 - DNA, 527 bp, Homo sapiens
  misc_feature: HEFZJCU01AUE3F.10.9.A09.1.454.heavy.3.raw
catagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacggggtgtatactactgtacggaagggaggggggaaccgagcggggagttccgaagtactcctttgacgtcgtggggccg

SEQ ID NO: 461264 - DNA, 518 bp, Homo sapiens
  misc_feature: HEFZJCU01DK4HF.2.85.H08.1.454.heavy.3.raw
acgctcgacacacgaccggtgctcgatttagtatcactcagtcgcggggccctgggagcacagctcatcaccatggactggacctggaggttcctctttgtggtggcagcagctacaggtgtccagtcccaggtccagctggtgcagtctggggctgaggtgaagaagcctgggtcctcggtgagggtctcctgcaaggcttctggaggcaccttcaggacctatattatgacctgggtgcgacaggcccctggacaagggcttgagtggctgggggggatcatccctatgtttggtgaagcaaattacgcacagaagttccggggaagagtctcgattaccgcggacgaatccacgaacacagcctacatggaagtgaccagcctgagatctgaagacacggccgtgtattactgtgcgaagtcgtattactatgatactggtgattatttgaatttcgactcctaccactacggtatggacgtctggggccagggggaccacggtcaccgtctctt

SEQ ID NO: 461265 - DNA, 480 bp, Homo sapiens
  misc_feature: HEFZJCU01CL16U.4.37.D04.1.454.heavy.3.raw
  modified_base (479)..(479): a, c, t, g, unknown or other
agcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagcacagcctacatggacctgagcggcctgacatctgacgacacggccgtatatttctgtgcgagggana

SEQ ID NO: 461266 - DNA, 532 bp, Homo sapiens
  misc_feature: HEFZJCU01BLIHJ.12.39.D06.1.454.heavy.3.raw
  modified_base (377)..(377): a, c, t, g, unknown or other
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagaggggganagtggagtagaacgtaaatacgggaaaccgtttgacttttggggccagggaaccctggtcaccgtctcctcagcctccaccaaggcccatcggtcttccccctggctaccctcctccaagagcacctctgggggcacagcggccctgggctgcct

SEQ ID NO: 461267 - DNA, 517 bp, Homo sapiens
  misc_feature: HEFZJCU01A8JI8.10.53.E09.1.454.heavy.3.raw
catagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcgtcgggggaataccttcagcacgtggggccac

SEQ ID NO: 461268 - DNA, 515 bp, Homo sapiens
  misc_feature: HEFZJCU01DKTU2.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaaggccatcggtcttcccctggcaccctcctccaagagcacctctgggggcacagcggccctgggctgcctggtcaaggactactcctagagacacg

SEQ ID NO: 461269 - DNA, 492 bp, Homo sapiens
  misc_feature: HEFZJCU01D3ZZ4.4.57.F02.1.454.heavy.3.raw
agcactgtagcacgaccggtgctcgatttagctcgatatagttgggttggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctgctccaggagcacctctgggggcacagcggccctgggctgcctggtcaaggactacgttccctacagtgct

SEQ ID NO: 461270 - DNA, 504 bp, Homo sapiens
  misc_feature: HEFZJCU01C171Q.52.86.H09.1.454.heavy.3.raw
cgcagtacgacacgaccggtgctcgatttagtgctatagacttgggtttggggctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagcccg

SEQ ID NO: 461271 - DNA, 489 bp, Homo sapiens
  misc_feature: HEFZJCU01A6ZTC.49.4.A04.1.454.heavy.3.raw
agtcgagagacacgaccggtgctcgatttagagtagtgatcaggggtgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgctgcctctggattcaccttcagggtctatgacatgcactgggtccgccaggctccaggcaaggggctggagtgggtggcatttatctcatatgatggaagcaagatatactacattgactccgtgaagggccgattcatcatctccagagacaactccgagaacacactgtatcttcaaatgaacaggttgagagctgaagacacggctttatattactgtgcgaacttaatcacggaggacaac

SEQ ID NO: 461272 - DNA, 496 bp, Homo sapiens
  misc_feature: HEFZJCU01EKXZW.4.21.B10.1.454.heavy.3.raw
agcactgtagcacgaccggtgctcgatttagtgtcgtcgcaagagagggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggcccaagggaccacagtcaccgtctcctcaacctccaccaaggcccatcggtcttcccctggcgccctgctccaggagcacctccgagagcacagcggcccgtgggctgcctggtcaaggactacttccctacagtgct

SEQ ID NO: 461273 - DNA, 482 bp, Homo sapiens; identical to SEQ ID NO: 461259
  misc_feature: HEFZJCU01BBHNL.10.35.D02.1.454.heavy.3.raw

SEQ ID NO: 461274 - DNA, 514 bp, Homo sapiens
  misc_feature: HEFZJCU01DBP2G.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtcgtggggaccg

SEQ ID NO: 461275 - DNA, 538 bp, Homo sapiens
  misc_feature: HEFZJCU01C9HP8.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaccaaaactgatggtgggacaacagctacgctgcacccgtgaaaggcagattcaccatctcaagagatgattcaaaaagcacgctgtatctgcaaatgaacagcctgagaaccgaggacacagccgtgtattaactgtaccacactccctgaaacgcgtacaactactactactacggtatggacctctgggaccg

SEQ ID NO: 461276 - DNA, 327 bp, Homo sapiens
  misc_feature: HEFZJCU01A1VRI.40.20.B09.1.454.heavy.3.raw
tctagcgactcacgaccggtgctcgatttagtgtagtgtgaagggccgattcaccatctccagagacaacgccgggaactccctgtatctgcaaatgaagagcctgcgagccgaggacacgggtgtttattattgtactaaaggacaagagggactttgggagtattactacggtatggacgtctggggccaagggaccgccgtcaccgtctcctcagcttccaccaagggcccatcggtcttccccctggcgccctgctccaggagcacctctgggggcacagcggccctgggctgcctggtcaaggactacttccagtcgctaga

SEQ ID NO: 461277 - DNA, 379 bp, Homo sapiens; identical to SEQ ID NO: 444450
  misc_feature: HEFZJCU01BIV9C.47.77.G11.1.454.heavy.3.raw

SEQ ID NO: 461278 - DNA, 487 bp, Homo sapiens
  misc_feature: HEFZJCU01CBC99.22.86.H09.1.454.heavy.3.raw
acatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagagcgaggacacggcagtgtattactgtgcgagagatcgacatgaacg

SEQ ID NO: 461279 - DNA, 499 bp, Homo sapiens; identical to SEQ ID NO: 446805
  misc_feature: HEFZJCU01BDPTL.3.20.B09.1.454.heavy.3.raw

SEQ ID NO: 461280 - DNA, 379 bp, Homo sapiens; identical to SEQ ID NO: 444450
  misc_feature: HEFZJCU01AYD2U.47.77.G11.1.454.heavy.3.raw

SEQ ID NO: 461281 - DNA, 520 bp, Homo sapiens
  misc_feature: HEFZJCU01EYLZT.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaaagatcctgaggcctataccacctcagtcagctggttcgacccctgggccagggaaccctggtcaccgtctcctcagctccaccaaggcccatcggtcttcccctggccaccctcctccaagagcacctctgggggcacgagcggccctgggctgcctggtcaaggactacttccgagtagtacacg

SEQ ID NO: 461282 - DNA, 526 bp, Homo sapiens; identical to SEQ ID NO: 460789
  misc_feature: HEFZJCU01CHQNV.16.27.C05.1.454.heavy.3.raw

SEQ ID NO: 461283 - DNA, 543 bp, Homo sapiens
  misc_feature: HEFZJCU01EXXCQ.18.59.F04.1.454.heavy.3.raw
tacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaactgatggtgggacaacagactacgctgcacccgtgaaaggcagattcaccatctcaagagatgattcaaaagacacgctgtatctgcaaatgaacagcctgagaaccgaggacacagccgtgtattactgtaccacatcccctgaaagcgtacaactactactactacggtatggacctctggggccaagggacccg

SEQ ID NO: 461284 - DNA, 507 bp, Homo sapiens
  misc_feature: HEFZJCU01BUU6U.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagctttgatctctgggccaagggacactggtcaccgtctcttcagcctccaccaagggcccatcggtcttcccctggccgccctgctccaggacg

SEQ ID NO: 461285 - DNA, 510 bp, Homo sapiens
  misc_feature: HEFZJCU01A493Y.7.28.C06.1.454.heavy.3.raw
  modified_base (337)..(337): a, c, t, g, unknown or other
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggngacctactatttggactctgtgaggggccgattcatcatctccagagacaacgccgacaactcactgtctctgctgatgagcagcctgagagccgacgacacggctatctattactgtgcgaaactctcattccgttcatctgaatacgtgggccagggaccctggtcgtccg

SEQ ID NO: 461286 - DNA, 465 bp, Homo sapiens; identical to SEQ ID NO: 445132
  misc_feature: HEFZJCU01ES9VT.5.86.H09.1.454.heavy.3.raw

SEQ ID NO: 461287 - DNA, 517 bp, Homo sapiens
  misc_feature: HEFZJCU01AOIRX.52.53.E09.1.454.heavy.3.raw
cgcagtacgacacgaccggtgctcgatttagagagagtgtgttgggtttgggggggagaggagcccagcactgggattccgaggtgtttccattcagtgatctgcactgaacacagaggactcgccatggagtttgggctgagctgggttttccttgttgctattttaaaaggtgtccagtgtggagtgcaggtggtggagtctgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccgagggggcgggagcacgccccgtaacttcgtggggcc

SEQ ID NO: 461288 - DNA, 517 bp, Homo sapiens; identical to SEQ ID NO: 458073
  misc_feature: HEFZJCU01D408K.9.34.D01.1.454.heavy.3.raw

SEQ ID NO: 461289 - DNA, 514 bp, Homo sapiens
  misc_feature: HEFZJCU01DVO65.13.76.G10.1.454.heavy.3.raw
tcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgttcttcaaatgaacagcctgagagccgatgacacggccgtgtattactgtgcgagagatggggcccacgaacgttactacgctatggacgtctggggccaaac

SEQ ID NO: 461290 - DNA, 375 bp, Homo sapiens; identical to SEQ ID NO: 445125
  misc_feature: HEFZJCU01C7AYH.9.53.E09.1.454.heavy.3.raw

SEQ ID NO: 461291 - DNA, 488 bp, Homo sapiens; identical to SEQ ID NO: 452390
  misc_feature: HEFZJCU01ANS96.49.82.H05.1.454.heavy.3.raw

SEQ ID NO: 461292 - DNA, 507 bp, Homo sapiens
  misc_feature: HEFZJCU01B9E88.22.11.A11.1.454.heavy.3.raw
acatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctgggttcaccgtcagtagcaagtacatgagctgggtccgccaggctccagggaaggggctggagtggatctcagttatttatctcggtggtaacacatactacgcagactccgtggagggccgattcaccatctccagagacaattccaagaacacggtgtatcttcaaatgaacagcctgagagccgatgacacggccgtgtattactgtgtgagatcaaaattccaagccgcgggggtcacccgaaatgtacc

SEQ ID NO: 461293 - DNA, 525 bp, Homo sapiens
  misc_feature: HEFZJCU01C7RXW.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcgggggacctcaccctggttctacttcgatctctggggccgt

SEQ ID NO: 461294 - DNA, 524 bp, Homo sapiens
  misc_feature: HEFZJCU01EBD8X.53.2.A02.1.454.heavy.3.raw
cgcgtatacacacgaccggtgctcgatttagactcatctacaggggatactttctgagagtcctggacctcctgtgcaagaacatgaaacatctgtggttcctccttctcctggtggcagctcccagatgggtcctgtcccaggtgcagctgcaggagtcgggcccaggactcgtgaagccttcggagaccctgtccctcacctgcattgtctctggtggctccatcagtacttactactggacctggatccggcggtccccagggaggggactggagtggattgggaatgtccgttacagtgggaccaccaactacaacccctccctcaagagtcgagtcaccatatcagtagacacgtccaagaaccgcttctccctgaatctgaactctgtgaccgctgcggacacggccctctattactgtgcgagagtctacgcgccggacgacgatatttgactggttatcacaacccactatattactttgactactggggccagggaaccctggtcaccgtctcct

SEQ ID NO: 461295 - DNA, 499 bp, Homo sapiens; identical to SEQ ID NO: 444610
  misc_feature: HEFZJCU01C1P4I.15.70.G04.1.454.heavy.3.raw

SEQ ID NO: 461296 - DNA, 519 bp, Homo sapiens
  misc_feature: HEFZJCU01DBVYT.48.35.D02.1.454.heavy.3.raw
agtatacatacacgaccggtgctcgatttagcacacgatagttgggtttgggggctttctgagagtcatggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactgggcctggatccgccagcccccgggaagggactggaatggattgggagtatctattatacagggagcacctactacaacccgtccctcaagagtcgagtcaccatctccgcagacacgtccaagaaccagttctccctgaggctgagctctgtgaccgccgcagacacggctgtctattactgtgcgagaagtgggtcgtggcagtggctggtacgtggctctcagtggttccgacccctgggggccaggggatacctggtcctaccg

SEQ ID NO: 461297 - DNA, 498 bp, Homo sapiens
  misc_feature: HEFZJCU01DCNNK.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaagggctggagtgggtggcagtcatatcaattgatggagccataaaattttatgcggactccgtgaacggttcgattcaccatctccagagacaattccaggaacacactgtttctgcaaatgaacagcctgagaattgaggaactcgggtatatactactgtgccgtcgacccctgactgataaccggactggttcgaccctcgggccgagggaacctggtcaccgtctcct

SEQ ID NO: 461298 - DNA, 543 bp, Homo sapiens
  misc_feature: HEFZJCU01C6OZI.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccggattcaccatctccagagacaattacaagaacaaccctttatctgcaaatagacagcccccctgagaccagacgacacggctgtctattattgcgcgagagagacacacgaacctactcggccaatactatgggggcgttgttcgtggggccgaggggacccgtggtcatcgtctccccacgcctccaccaacggcccactcggtccttcccctcggccgccctcg

SEQ ID NO: 461299 - DNA, 498 bp, Homo sapiens
  misc_feature: HEFZJCU01AZ509.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctgggg

SEQ ID NO: 461300 - DNA, 539 bp, Homo sapiens
  misc_feature: HEFZJCU01D38GV.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatcctccagagacaacgccaagaattcactgtatctacaactgaacagcctgagagtcgcagacacggccgtgtattactgtgcgagatgtaggaaaaagtaagtgctgtgtttagttggggccagggacgccgtggtcaccg

SEQ ID NO: 461301 - DNA, 480 bp, Homo sapiens
  misc_feature: HEFZJCU01BDNRD.19.67.G01.1.454.heavy.3.raw
tactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagactttttctcagaacacactgtctcttcaaatgaacagcctgagggccgaggacacggccgtctattattgtgtgagagtttatggcgatggctggtggacagatcactggggccagggaaccctggtcaccgtctcctcagcctccaccaagggcccatcgtcttcccctggcgccctgctccaggagcacctccgagagcacagcggccctgggctgcctggtcaaggactacttcccacgagagta

SEQ ID NO: 461302 - DNA, 446 bp, Homo sapiens
  misc_feature: HEFZJCU01AP8LU.3.86.H09.1.454.heavy.3.raw
agacgcactccacgaccggtgctcgatttagtgctatagacttgggtttggggattcacgttgcagatgtaggtctgggtgcgacaggctcctggaaaagggcttgagtggatgggaggttttgatcctgaagagcgtgaaagaatctacgcacagaatttccagggcagagtcaacatgaccgaggacacatccacagacacatcctacatggagttgaccagcctgagatctgaagacacggccgtgtattattgtgcaacagtcgcggctagcgcagcgggccctgatgcttttgatatctggggcccagggacattggtcaccgtctcttcagcctccaccaagggcccatcggtcttccccctggcaccctcctccaagagcacctctgggggcacagcggccctgggctgcctggtcaaggactacttccgagtgcgtct

SEQ ID NO: 461303 - DNA, 503 bp, Homo sapiens
  misc_feature: HEFZJCU01DL46G.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggcgtgtattactgtgtcgagactggccgcaacagactacggtggcgaactcctactgctttgtatatctgggtccgaaggacg

SEQ ID NO: 461304 - DNA, 483 bp, Homo sapiens; identical to SEQ ID NO: 444932
  misc_feature: HEFZJCU01CCEPA.7.10.A10.1.454.heavy.3.raw

SEQ ID NO: 461305 - DNA, 506 bp, Homo sapiens
  misc_feature: HEFZJCU01A9056.51.71.G05.1.454.heavy.3.raw
cgatcgtatacacgaccggtgctcgatttagtgtcgtcgcaagagagagggggtctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctattgttttactgtgcgagagggaactcgattacagcacgtcccg

SEQ ID NO: 461306 - DNA, 396 bp, Homo sapiens; identical to SEQ ID NO: 444469
  misc_feature: HEFZJCU01BSIAE.47.46.E02.1.454.heavy.3.raw

SEQ ID NO: 461307 - DNA, 409 bp, Homo sapiens; identical to SEQ ID NO: 444519
  misc_feature: HEFZJCU01ERV2S.3.41.D08.1.454.heavy.3.raw

SEQ ID NO: 461308 - DNA, 513 bp, Homo sapiens
  misc_feature: HEFZJCU01C91FF.47.53.E09.1.454.heavy.3.raw
agctcacgtacacgaccggtgctcgatttagagagagtgtgttgggtttggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactcatttattgggatgatgtgaagtactacagtccatatttcaagaggctcactatcaccaaggacacttccaaaaaccaagtggtcctgacaatgaccaacgtgaagcctgcggacacggccacatattattgtgcacaccgacgctataccgccagctgggaaatcgacaactggttgacccctggggccagggaacccttgtcaccgtctcctcagcctccaccaaggccc

SEQ ID NO: 461309 - DNA, 491 bp, Homo sapiens
  misc_feature: HEFZJCU01B2F0P.4.28.C06.1.454.heavy.3.raw
  modified_base (401)..(401): a, c, t, g, unknown or other
agcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgaggggccgattcaccatcttcagagacaacgccaaggacacgctgtatctggaaatgagcagtctgagagccgaggacacggctgtgtattactgtgcaagagataacggacttggtacgccctttgactactggggcccgggaccctggtcaccgtctcctcggcctccaccaagggcccancggtcttcccctggcgccctgctccaggagcacctccgagagcacagcggccctgggctgcctggtcaaggactacttccctacagtgct

SEQ ID NO: 461310 - DNA, 413 bp, Homo sapiens
  misc_feature: HEFZJCU01D2LE8.11.67.G01.1.454.heavy.3.raw
cgagagataccacgaccggtgctcgatttagagtatacatattgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtccagatattgcactggtggcaactgctacgacgcctactattatcaccacatggacgtctggggcaaagggaccacggtcatcgtctcctcagcctccaccaaggggccccatccggtcttcccccctggccaccctcctccaagagcacctctgggggcacagcggccctgggctgcctggtcaaggactacttccgtatctctccg

SEQ ID NO: 461311 - DNA, 502 bp, Homo sapiens
  misc_feature: HEFZJCU01EIDQ0.48.34.D01.1.454.heavy.3.raw
agtatacatacacgaccggtgctcgatttagatcgtctgtgttgggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaagggactacttcctatgtatact

SEQ ID NO: 461312 - DNA, 530 bp, Homo sapiens
  misc_feature: HEFZJCU01B3MU3.3.70.G04.1.454.heavy.3.raw
agacgcactccacgaccggtgctcgatttagtgtagtgtgaagggaaagggggggagaggagcccaccactgggattccgaggtgtttccattcggtgatcagcactgaacacagaggactcaccatggagttttggctgagcgtgggttttccttgttggctatttcaaaaggtgtccagtgtgaggtgcagctggtggagactggaggaggcttgatccagcccggggggtccctgagactctcctgtgaagtctctgggttcactgtcagtagcaactacatgaactgggtccgccaggctccagggaaggggccggagtgggtctcaattatttatggcgatggtagtacgtactacgcagactccgtgcagggccgattcaccatctccagagacaatttcaagaatacgttgctccttcaaatgaacaacctgagaaccgaggacacggccgtatattattgtgcgagtagtacggtggtgaatgtggtgttaactggggcctgggacctggtcacgtctcctc

SEQ ID NO: 461313 - DNA, 513 bp, Homo sapiens
  misc_feature: HEFZJCU01DDQE6.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgtaaactctcattccgttcatctgaatactggggccagggaaccctggtccgtccg

SEQ ID NO: 461314 - DNA, 529 bp, Homo sapiens
  misc_feature: HEFZJCU01AJ2G1.51.37.D04.1.454.heavy.3.raw
cgatcgtatacacgaccggtgctcgatttagtagcatactgttgggttttccttgttgctattatagaaggtgtccagtgtcaggtgcagctggtggaatctgggggaggcttggtcaagcctggagggtccctgagactctcctgtgcagcctctggattcaccttcagtggctacttcatgagctggatccgccaggctccagggaagggctgcagtgggtctcacatattagtgctaatgggagaaccacattctacgcagactctgtgaagggccgattctccatctccagggacaacgccaagaactcactgtatctgcaaatgaacagtctaagagccgaagacacggccgtgtacttctgtgcgagtgtgggagaggactacggtgacacggagcctttctcctactacttcggtgtggacgtcgtgggccaagggaccacggtcaccgtctcctcacgcctcccaccaacgggcccacgtccggtcctttccccctcggccacccctccctcccaacgacg

SEQ ID NO: 461315 - DNA, 522 bp, Homo sapiens
  misc_feature: HEFZJCU01CPSOE.4.33.C11.1.454.heavy.3.raw
agcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagatcatcatctcaagagatgattccaacggcatcgcctatctgcagatgaacagcctgaagaccgaggacacagccgtctattactgtgttaggggtaggttttacggtatttttggtaggtggagtatttaa

SEQ ID NO: 461316 - DNA, 512 bp, Homo sapiens
  misc_feature: HEFZJCU01C5CFV.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccaggggaaggggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagaccgctactggggcccgggagccctggtcc

SEQ ID NO: 461317 - DNA, 506 bp, Homo sapiens
  misc_feature: HEFZJCU01BXN4H.22.36.D03.1.454.heavy.3.raw
acatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacagccgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctattttgggccgtcgggccgactac

SEQ ID NO: 461318 - DNA, 517 bp, Homo sapiens; identical to SEQ ID NO: 445699
  misc_feature: HEFZJCU01A0J2S.26.71.G05.1.454.heavy.3.raw

SEQ ID NO: 461319 - DNA, 494 bp, Homo sapiens
  misc_feature: HEFZJCU01B03EJ.51.78.H01.1.454.heavy.3.raw
cgatcgtatacacgaccggtgctcgatttagtgtgagtagtttgggtttgggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggccatcggtcttcccctggcaccctcctccaagagcacctctcgggggcacagcggccctgggctgcctggtcaaggactacttctcgtagcact

SEQ ID NO: 461320 - DNA, 510 bp, Homo sapiens
  misc_feature: HEFZJCU01CN7G6.49.38.D05.1.454.heavy.3.raw
agtcgagagacacgaccggtgctcgatttagtatctgatagttgggtttggggggaagaggaagactgacggtcctcccaggagttcaggtgctgggcaccgtgggcatgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctggggccagggagccctggtcaccgtctcctcagcttccaccaagggcccatcggtcttcccctggcgccctgctccaggagc

SEQ ID NO: 461321 - DNA, 505 bp, Homo sapiens; identical to SEQ ID NO: 445664
  misc_feature: HEFZJCU01CFHRQ.12.33.C11.1.454.heavy.3.raw

SEQ ID NO: 461322 - DNA, 521 bp, Homo sapiens
  misc_feature: HEFZJCU01DWZZN.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccccggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgtttcacgctctatggttcggggagttattagtccctactttgactactggggccagggaactctggtcaccgtctccgcagcctccaccaagggccccatcggt

SEQ ID NO: 461323 - DNA, 481 bp, Homo sapiens
  misc_feature: HEFZJCU01BY51T.40.22.B11.1.454.heavy.3.raw
tctagcgactcacgaccggtgctcgatttagacgacagctcagggggctctcagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtacagcctggggggtccctgagactctcctgtgcagcctctggattcaccttcagtagctatagcatgaactgggtccgccaggctccagggaaggggctggagtgggtttcatacattagtagtagtagtagtaccatatactacgcagactctgtgaagggccgattcaccatctccagagacaatgccaagaactcactgtatctgcaaatgaacagcctgagagacgaggacacggctgtatattactgtgcgagagagcca

SEQ ID NO: 461324 - DNA, 491 bp, Homo sapiens; identical to SEQ ID NO: 446104
  misc_feature: HEFZJCU01BCYOW.3.34.D01.1.454.heavy.3.raw

SEQ ID NO: 461325 - DNA, 527 bp, Homo sapiens; identical to SEQ ID NO: 456786
  misc_feature: HEFZJCU01EB65O.14.35.D02.1.454.heavy.3.raw

SEQ ID NO: 461326 - DNA, 512 bp, Homo sapiens
  misc_feature: HEFZJCU01D1YAP.53.51.E07.1.454.heavy.3.raw
  modified_base (494)..(494): a, c, t, g, unknown or other
cgcgtatacacacgaccggtgctcgatttagcatactctacaacacacaaagggggagagaggagcccagccctgggattctcaggtgttctcatttggtgatcaggactgaacagagagaactcaccatggagtttgggctgagctggcttcttacgttgtggctattttaaaaggtgtccagtgtgaggtgcaactggtggagtcggggggaggcctggtacagcctggggggtccctgagactctcctgtgcagcctctggattcacctttagcaactatggcatgagttgggtccgccagtctcctgggaaggggctggagtgggtctcaagtgttggtggtatgggtgataatccatactacgctgactccgtgaagggccggttcaccatctccagagacaattccaagaacacggtgaatctgcaaatcaacagcctgagagtcgaggacacggccgtgtatactgtgcgaaagacatgtccgaacncggtggctggtacaatgt

SEQ ID NO: 461327 - DNA, 509 bp, Homo sapiens
  misc_feature: HEFZJCU01ETKXP.52.28.C06.1.454.heavy.3.raw
cgcagtacgacacgaccggtgctcgatttagagctcacgtattgggtttggggagctctgggagaggagcccagcactgggattccgaggtgtttccattcagtgatctgcactgaacacagaggactcgccatggagtttgggctgagctgggttttccttgttgctattttaaaaggtgtccagtgtggagtgcaggtggtggagtctgggggaggcttggtccagcctggtggttccctgagactctcctgtgcagcctctggattctccgtcagtagcaactacatgagctgggtccgccaggctccagggaagggctggagtgggtctcaagtctttatgtcggtggtaccacatattatgctgactccgtgaaggccgattcaccatctccagagacgagtccaggaacagcctgtttctcaaatggacagtctgagacctgacgacacggctgtctattactgtgcgagagaacccgagggggcggagcagccccgtaattc

SEQ ID NO: 461328 - DNA, 501 bp, Homo sapiens
  misc_feature: HEFZJCU01CCKRZ.19.26.C04.1.454.heavy.3.raw
tactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagcgtgggggacacggctgtgtattactgtgcgagagcggctggcaactacatccatttac

SEQ ID NO: 461329 - DNA, 537 bp, Homo sapiens
  misc_feature: HEFZJCU01EU17I.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggccgtttcatgtctggggccaagggacgctggtcaccgtctcttcagcctccaccaaggcccatcggtcttcccctggcaccctcctccaagagcacctctgggggcacagcc

SEQ ID NO: 461330 - DNA, 511 bp, Homo sapiens
  misc_feature: HEFZJCU01C9IMO.49.5.A05.1.454.heavy.3.raw
agtcgagagacacgaccggtgctcgatttagatagatagacagggggctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggaggcgtggtccagcctgggacgtccctgagactctcctgtgcagcctctggatttacattcagtagttatgctatgcactggtttcgccagggtccaggcaaggggctggagtgggtggcagttatatcgtatgatggaaacgaaaatactacgcagactccgtgaagggccgattcaccatctcccgacacaattccaagaacacattgtttctactgctgaacagcctgagaagtgacgacacggctgtatatcactgtgcggcaggcaacgattactacccgaaggactactggggaccg

SEQ ID NO: 461331 - DNA, 518 bp, Homo sapiens; identical to SEQ ID NO: 447436
  misc_feature: HEFZJCU01AFVBD.13.76.G10.1.454.heavy.3.raw

SEQ ID NO: 461332 - DNA, 503 bp, Homo sapiens; identical to SEQ ID NO: 455891
  misc_feature: HEFZJCU01A58VA.48.37.D04.1.454.heavy.3.raw

SEQ ID NO: 461333 - DNA, 504 bp, Homo sapiens; identical to SEQ ID NO: 459975
  misc_feature: HEFZJCU01BFKGM.17.25.C03.1.454.heavy.3.raw

SEQ ID NO: 461334 - DNA, 535 bp, Homo sapiens
  misc_feature: HEFZJCU01BRSA0.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtcccgtcagcccccaggaaaggccctggaatgggttgcacttatttattgggatgacggttaccgctacagtccatctctgaggaggagactcaccatcaccaaggacacccccaaaaaccaggtggtccttacaatgaccaccatggaccctgtggacacagccacatatttctgtgcacactctataggagcacctggtagtctgccaaactggttcgacccctggggcccgggaaccctggtcaccgtctcctcagcctccaccaacgggcccatcggtcttcccctc

SEQ ID NO: 461335 - DNA, 517 bp, Homo sapiens
  misc_feature: HEFZJCU01CBX9P.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacgaacgttactacgctatggacgtcgtggggaccg

SEQ ID NO: 461336 - DNA, 478 bp, Homo sapiens; identical to SEQ ID NO: 448105
  misc_feature: HEFZJCU01CL9H2.26.78.H01.1.454.heavy.3.raw

SEQ ID NO: 461337 - DNA, 515 bp, Homo sapiens
  misc_feature: HEFZJCU01A6E9U.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcacccgtggtcaccgtctcctcagcttccaccaagggcccatcggtcttcccctggcgccctgctccaggagcacctcgtgggggcacgagcggccctgggctgcctggtcaaggactactcccatacc

SEQ ID NO: 461338 - DNA, 520 bp, Homo sapiens
  misc_feature: HEFZJCU01BCSB1.48.5.A05.1.454.heavy.3.raw
agtatacatacacgaccggtgctcgatttagatagatagacagggggctctgagagaggagcccagccctgggattttcaggtgttttcatttggtgatcaggactgaacagagagaactcaccatggagtttgggttgagctggctttttcttgtggctattttaaaaggtgtccagtgtgaggtgcagctgttggagtctgggggaggcttggtacagccgggggggtccctgagactctcctgtgcaacctctggattcacctttaggggctatgccatgaactgggtccgccaggttcctgggaaggggctggagtgggtctcatctattagtgagactggtgatactacagactacgcagactccgtgaggggccggttcaccgtctccagagacaattccaagaacacgctatttctgcaaatgaacagcctgagagtcgacgacacggccgtatactactgtgcgagacagatgctgccgcctgtccgtggggccagggaacctggtcaccgt

SEQ ID NO: 461339 - DNA, 495 bp, Homo sapiens
  misc_feature: HEFZJCU01D20PP.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgccttgatatgtgggccaagggacaatgtcaccgtct

SEQ ID NO: 461340 - DNA, 503 bp, Homo sapiens; identical to SEQ ID NO: 445995
  misc_feature: HEFZJCU01D6FEC.17.25.C03.1.454.heavy.3.raw

SEQ ID NO: 461341 - DNA, 524 bp, Homo sapiens
  misc_feature: HEFZJCU01EAMJ8.13.33.C11.1.454.heavy.3.raw
tcacgtactacacgaccggtgctcgatttagagtgagctcgttgggtttggggatgctttctgagagtcatggatctcatgtgcaagaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacggcaaatatggttcagggtagttcgactacgtggggccagggaaccctggtccaccgtctcctcagccctccaccaaggg

SEQ ID NO: 461342 - DNA, 517 bp, Homo sapiens
  misc_feature: HEFZJCU01BOVF5.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaaccctggtcgccgtctcctcagcctccaccaagggcccatcggtcttcccctggcaccctcctccaagagcacctctgggggcacagcggccctgggctgcctggtcaaagactacttccagacgtatca

SEQ ID NO: 461343 - DNA, 530 bp, Homo sapiens
  misc_feature: HEFZJCU01DL887.4.66.F11.1.454.heavy.3.raw
agcactgtagcacgaccggtgctcgatttagtcacgcgagaagggggggagaggagccccagccttgggattcccaagtgttttcattcagtgatcaggactgaacacagaggactcaccatggagtttgggctgagcgtggattttccttaacgtgctattttaaaaggtgtccagtgtgaggtgaaactggtggagtctgggggaggcttgataaagcctggggggtcccttagactctcctgtgcagcctctggattcaccttcagtgacgactggatgaattggatccgccaggctccagggaaggggctggagtgggtcggccatattaagcccaaaactgaacgtgggaaacagactacgctgcacccgtgagaggcagattcaccatttcaagagatgattcaaaagtacactgtatctggaaatgaacagcctgagaatcgacgacacagccgtttattactgcagaagagggcactatggtccctggggccacgggaaccctgggtcaccgtctcctcacg

SEQ ID NO: 461344 - DNA, 446 bp, Homo sapiens
  misc_feature: HEFZJCU01EWKEI.2.41.D08.1.454.heavy.3.raw
acgctcgacacacgaccggtgctcgatttagtcacgcgagaaagggaaaggggctggaatatgttgcaactattactactaatgggggtagtacatattatgcaaactctgtaaagggcagattcaccatctccagagacaattccaagaacaccttatatcttcaaatgggcagcctgagagttgaggacatggctgtgtattactgtgcgagagatgggggatattgtggtggtgattgtcttttatttcgaagaagaggaaacttgggggccggactattataactacgctatggacgtctggggccaagggaccacggtcaccgtctcctcagcctccaccaagggcccatcggtcttccccctggcaccctcctccaagagcacctctgggggcacagcggccctgggctgcctggtcaaggactacttcctgtcgagcgt

SEQ ID NO: 461345 - DNA, 541 bp, Homo sapiens
  misc_feature: HEFZJCU01EJSBZ.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctcagagacaacgccaagaattcactgtatctacaactgaacagcctgagagtcgcagacacggccgtgtattactgtgcgagatgtaggaaaaagtaatggcttgtgtttaagttggggccagggacgccctggtctacccg

SEQ ID NO: 461346 - DNA, 491 bp, Homo sapiens
  misc_feature: HEFZJCU01CXJU5.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaagggctggaatgggtctcatctattagtgctactactggtggcacatacttcgcagactccgtgaagggccggttctccatctccagagacaattccaagaacacgctgtatctgcaattgaacagcctgagagccgaggacacggccgtatattactgtgcgaaagattggggaatgaccacgtc

SEQ ID NO: 461347 - DNA, 370 bp, Homo sapiens; identical to SEQ ID NO: 445884
  misc_feature: HEFZJCU01D7W0R.3.42.D09.1.454.heavy.3.raw

SEQ ID NO: 461348 - DNA, 491 bp, Homo sapiens; identical to SEQ ID NO: 456439
  misc_feature: HEFZJCU01D0ED9.10.29.C07.1.454.heavy.3.raw

SEQ ID NO: 461349 - DNA, 515 bp, Homo sapiens
  misc_feature: HEFZJCU01BVTIB.16.71.G05.1.454.heavy.3.raw
  modified_base (498)..(498): a, c, t, g, unknown or other
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctggggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaaggccggttcaccatctccagagacaattccaagaacacactgtatctgcaaatgaacagcctgagagccgacgacacggccatatattactgtgcgaaagcaccggcagttagtcacccatacctactttnactacgtcggggccaac

SEQ ID NO: 461350 - DNA, 531 bp, Homo sapiens
  misc_feature: HEFZJCU01A5A9Z.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcctttttacacctcccttgacttctggggccatggaaccccggtaccg

SEQ ID NO: 461351 - DNA, 503 bp, Homo sapiens
  misc_feature: HEFZJCU01AM1ZL.13.55.E11.1.454.heavy.3.raw
tcacgtactacacgaccggtgctcgatttagcactcgcacgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactaccctgtatctgcaaatgaacagcctgagagctgaggacacggccttgtattattgtgacaaaagatccaaccccttacgt

SEQ ID NO: 461352 - DNA, 390 bp, Homo sapiens; identical to SEQ ID NO: 444541
  misc_feature: HEFZJCU01CS498.16.24.C02.1.454.heavy.3.raw

SEQ ID NO: 461353 - DNA, 500 bp, Homo sapiens
  misc_feature: HEFZJCU01D0V1P.53.41.D08.1.454.heavy.3.raw
  modified_base (461)..(461): a, c, t, g, unknown or other
cgcgtatacacacgaccggtgctcgatttagtcacgcgagaaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacacgtccatcagcactgcctacatggagctgaccaggctgaaatttgaggacacggccatttattactgtncaaggaacagcataatgactcgtccccggactttgtacg

SEQ ID NO: 461354 - DNA, 493 bp, Homo sapiens
  misc_feature: HEFZJCU01DZ37N.48.59.F04.1.454.heavy.3.raw
agtatacatacacgaccggtgctcgatttagtacacacacttagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgtcctttgatatgtgggcgaagggac

SEQ ID NO: 461355 - DNA, 530 bp, Homo sapiens
  misc_feature: HEFZJCU01CP3QE.49.78.H01.1.454.heavy.3.raw
agtcgagagacacgaccggtgctcgatttagtgtgagtagtttgggtttgggctgagctgggttttccttgttgctattttaaaggtgtccagtgtgacgtgcaggtggtggagtctgggggaggcttggtccagcctggggggtccctgacactctcctgtatagtctctggattcaccgtcagtaacaactacatgagttgggtccgccaggctccagggaagggactggagtgggtctcagttatttatagcggtggtgacacatactacgcagactccgtgaagggcagattcaccatctccagagacggtttcaagaacacactctatcttcaaatgaacagcctgagagccgaggacacggctgtgtattactgtgcgagagatcccccgggtatagcagtgtctggtacatattactggggccagggaaccctggtcaccgtctcctcagcctccaccaagggcccatcggtcttcccctggcgccctgctccaggagcacctccgacgagcacagcggcccg

SEQ ID NO: 461356 - DNA, 508 bp, Homo sapiens
  misc_feature: HEFZJCU01A7D8N.22.82.H05.1.454.heavy.3.raw
acatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtctgggggaggcctggtacagccgggggggtccctgagactctcctgtgtagcctccggattcacctttagcagacatggcatgagctgggtccgccaggctccagggaagggccggagtgggtgtcagtcattagtagtagtggtgatagaatttaccacacagactccgtgaagggccgcttcaccatctctagagacaattcccagaacacactgtatctgcaaatgactaggctgagaggcgacgacacggccatttattactgcgcgaaggatatacgggtcgacaacggtggctacgcgttt

SEQ ID NO: 461357 - DNA, 506 bp, Homo sapiens
  misc_feature: HEFZJCU01A0HTR.52.34.D01.1.454.heavy.3.raw
cgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttcccctggcaccctcctccaagagcacctctgggggcacagcggccctggggctgcctggtcaaggactacttcctatacgatcg

SEQ ID NO: 461358 - DNA, 503 bp, Homo sapiens
  misc_feature: HEFZJCU01A7VFJ.10.23.C01.1.454.heavy.3.raw
catagtagtgcacgaccggtgctcgatttagtacacgtgattagggattgggaggcttggtacagcctggcaggtccctgagactctcctgtgcagcctctggattcagctttgatgaatatgccatggactgggtccggcaagttccagggaagggcctggagtgggtctcaggtattgattggaatagtggtaccattgcctatgcggactctgtgaagggccgattcaccatcaccagagacgacgccaggagctccctgtatctccaaatgaacagtctgagacctgaggacacggccttgtattactgtgtaagagggagtcagggtttcaactattatagtagtggttatgactactggggccagggaccctggtcaccgtctcctcagcctccaccaagggcccatcggtcttccccctggcgccctgctccaggagcacctccgagagcacagcggccctgggctgcctggtcaggactacttcccactactatg

SEQ ID NO: 461359 - DNA, 512 bp, Homo sapiens
  misc_feature: HEFZJCU01CIOE7.17.33.C11.1.454.heavy.3.raw
  modified_base (490)..(490): a, c, t, g, unknown or other
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtntccgcagcctccaccagggccc

SEQ ID NO: 461360 - DNA, 493 bp, Homo sapiens
  misc_feature: HEFZJCU01EISAQ.47.85.H08.1.454.heavy.3.raw
  modified_base (298)..(298): a, c, t, g, unknown or other
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccnccaggctccaggcaaggggctaggagtgggtggcggtcatatcgtccagtggacatcttcagtattacgcagactccctgaggggccgattcaccatcctccagagacaattcccagaacacggtctatctgcacctgaccagcctgagaactgacgacacgtctctctactactgtgcgagagagttgacgagt

SEQ ID NO: 461361 - DNA, 483 bp, Homo sapiens; identical to SEQ ID NO: 444924
  misc_feature: HEFZJCU01AHVO9.10.35.D02.1.454.heavy.3.raw

SEQ ID NO: 461362 - DNA, 518 bp, Homo sapiens; identical to SEQ ID NO: 449255
  misc_feature: HEFZJCU01DTMKH.3.17.B06.1.454.heavy.3.raw

SEQ ID NO: 461363 - DNA, 531 bp, Homo sapiens
  misc_feature: HEFZJCU01BNQ8W.17.80.H03.1.454.heavy.3.raw
cgtagactagcacgaccggtgctcgatttagctgtgcgtcgaagggaaaggggacccaaaaaccacacccctccttgggagaatcccctagatcacagctcctcaccatggactggacctggagcatccttttcttggtggcagcagcaacaggtgcccactcccaggttcaactggtgcagtctggaggtgaggtgaagaagcctggggcctcagtgaaggtctcctgcaaggcctctggttacacctttaccaactatggtattagttgggtgcggcaggcccctggacaagggcttgagtggatgggatggatcagccctaacattggtaaaacaaattatgcacagaggctccagggtagagtcaccctgaccacagacacatccactaacacagcctacatggaactgaggaccttgagatttgacgacacggccttctattactgtgcgagagtgagaggggcggtggtagctgctaccgccgtggggttcgaccactggggccagggaaccctggtcaccgtct

SEQ ID NO: 461364 - DNA, 501 bp, Homo sapiens
  misc_feature: HEFZJCU01EK657.19.26.C04.1.454.heavy.3.raw
tactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacgggctgtgtattactgtgcgagagcggctgggcaactacatccatttac

SEQ ID NO: 461365 - DNA, 506 bp, Homo sapiens; identical to SEQ ID NO: 444696
  misc_feature: HEFZJCU01CGYXK.16.34.D01.1.454.heavy.3.raw

SEQ ID NO: 461366 - DNA, 518 bp, Homo sapiens
  misc_feature: HEFZJCU01AGY6T.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccaagagcacctctgggggcacagcgcccgtggctgcctggtcaaggactacttcctagagacacg

SEQ ID NO: 461367 - DNA, 502 bp, Homo sapiens
  misc_feature: HEFZJCU01B371W.51.53.E09.1.454.heavy.3.raw
cgatcgtatacacgaccggtgctcgatttagagagagtgtgttgggtttggggtctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctggggggggctggtccagcctgggaggtccctgagactctcctgtgcaggctctgcatttcccttcagtaactacgctatcgattgggtccgccaggctccaggcaagggactggagtgggtggcagttatttcagctgatggaggcaataagttttacggagattctgcgagggggccgattcaccatatccagagacaactcccaagatatgatatatctgcaaatgaacagcctgagacctgaggacacggctatgtattattgtgcgtcagggggcagtgcctggccacgtg

SEQ ID NO: 461368 - DNA, 519 bp, Homo sapiens; identical to SEQ ID NO: 446650
  misc_feature: HEFZJCU01CPAD7.13.76.G10.1.454.heavy.3.raw

SEQ ID NO: 461369 - DNA, 476 bp, Homo sapiens
  misc_feature: HEFZJCU01DI2DW.26.78.H01.1.454.heavy.3.raw
agactatactcacgaccggtgctcgatttagtgtgagtagtttgggtttggggagacgagcccagcactggaagtcgccggtgtttccattcggtgatcatcactgaacacagaggactcaccatggagtttgggctgagctgggtttcctcgttgctcttttaagaggtgtccagtgtcaggtgcagctggtggagtctgggggaggcgtggtccagcctgggaggtccctgagactctcctgtgcagcctctggattcaccttcagttactatactatgcactgggtccgccaggctccaggcaaggggctggagtgggtggcagttatatcatatgatggaagcagcacatattacacagactccgtgaagggccgattcaccatctccagagacaatttgaagaacacgctgtatctgcaaatgaacagcctgagagctgagacacggctgtgttttactgtgcgagagaga

SEQ ID NO: 461370 - DNA, 509 bp, Homo sapiens; identical to SEQ ID NO: 445937
  misc_feature: HEFZJCU01DPXBV.13.71.G05.1.454.heavy.3.raw

SEQ ID NO: 461371 - DNA, 505 bp, Homo sapiens
  misc_feature: HEFZJCU01D08D2.52.53.E09.1.454.heavy.3.raw
cgcagtacgacacgaccggtgctcgatttagagagagtgtgttgggtttgggggggagaggagcccagcactgggattccgaggtgtttccattcagtgatctgcactgaacacagaggactcgccatggagtttgggctgagctgggttttccttgttgctattttaaaaggtgtccagtgtggagtgcaggtggtggagtctgggggaggcttggtccagcctggtggttccctgagactctcctgtgcagcctctggattctccgtcagtagcaactacatgagctgggtccgccaggctccagggaagggctggagtgggtctcaagtctttatgtcggtggtaccacatattatgctgactccgtgaagggccgattcaccatctccagagacgagtccaggaacagcctgtttctcaaatggacagtctgagacctgacgacacggctgtctattactgtgcgagagaacccgagggggcggagcacgcccgtaattcg

SEQ ID NO: 461372 - DNA, 526 bp, Homo sapiens
  misc_feature: HEFZJCU01ES7DF.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtccttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacggctgtttattactgtgcgcggtggctgaccgctcttgactactggggccggggagccccggtcatcgtct

SEQ ID NO: 461373 - DNA, 513 bp, Homo sapiens
  misc_feature: HEFZJCU01DLIX4.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaaccctggtcgccgtctcctcagctccacaaggccatcggtcttcccctggcaccctcctccaagagcacctctgggggcacagcggccctgggctgcctggtcaaggactacttccagacgtatca

SEQ ID NO: 461374 - DNA, 501 bp, Homo sapiens; identical to SEQ ID NO: 450868
  misc_feature: HEFZJCU01DVO87.26.23.C01.1.454.heavy.3.raw

SEQ ID NO: 461375 - DNA, 503 bp, Homo sapiens; identical to SEQ ID NO: 445995
  misc_feature: HEFZJCU01DZA8B.17.25.C03.1.454.heavy.3.raw

SEQ ID NO: 461376 - DNA, 509 bp, Homo sapiens; identical to SEQ ID NO: 452506
  misc_feature: HEFZJCU01B6PTN.4.81.H04.1.454.heavy.3.raw

SEQ ID NO: 461377 - DNA, 522 bp, Homo sapiens; identical to SEQ ID NO: 446788
  misc_feature: HEFZJCU01C03XV.12.40.D07.1.454.heavy.3.raw

SEQ ID NO: 461378 - DNA, 538 bp, Homo sapiens
  misc_feature: HEFZJCU01C9B12.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaatggctgtgtttagttggggccaggggagcccgtggtcaccg

SEQ ID NO: 461379 - DNA, 517 bp, Homo sapiens; identical to SEQ ID NO: 446917
  misc_feature: HEFZJCU01CVMK3.9.34.D01.1.454.heavy.3.raw

SEQ ID NO: 461380 - DNA, 535 bp, Homo sapiens
  misc_feature: HEFZJCU01ETSNL.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccccttggggcccgggggaaccctgggtcaccgtcctccccaccctccaaccg

SEQ ID NO: 461381 - DNA, 513 bp, Homo sapiens
  misc_feature: HEFZJCU01A5JNM.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctgggggccaagggaccacggtcatcgtctccgcagcctccaccaagggcccatcggtcttcccctggcaccctcctccaagagcacctctgggggcacagcggccctgggctgcctggtcaaggactacttccgagtgcgtct

SEQ ID NO: 461382 - DNA, 390 bp, Homo sapiens; identical to SEQ ID NO: 444654
  misc_feature: HEFZJCU01E0MDZ.16.17.B06.1.454.heavy.3.raw

SEQ ID NO: 461383 - DNA, 534 bp, Homo sapiens
  misc_feature: HEFZJCU01B1YLD.48.27.C05.1.454.heavy.3.raw
agtatacatacacgaccggtgctcgatttagacgcgatcgaagggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaactgctttgtctctggaacttctatcaagggtagcagcttctactggggctggatccgccagcccccaggaaaggggctacaatgggttggaaatgtcaattcttatgggcgctcccactacaatccggccctccagagtcgagccctcatatccatagacacgtccaacaaccagttttccctgacgctgacgtctgtgaccgccgcagacacggctgtctattattgtgcgagactaggcttctgtagtggtggtacttgcaacccgggatactactccaacttcggcttggacatctggggccaagggacctcggtcgccggtttt

SEQ ID NO: 461384 - DNA, 509 bp, Homo sapiens
  misc_feature: HEFZJCU01BESM7.4.67.G01.1.454.heavy.3.raw
  modified_base (484)..(484): a, c, t, g, unknown or other
agcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggctttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgcgaaaganctcgggctggtccgcggtccggggt

SEQ ID NO: 461385 - DNA, 502 bp, Homo sapiens
  misc_feature: HEFZJCU01BCHC2.48.55.E11.1.454.heavy.3.raw
agtatacatacacgaccggtgctcgatttagcactcgcacgttgggtttggggatgctttctgagagtcatggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactgggcctggatccgccagcccccgggaagggactggaatggattgggagtatctattatacagggagcacctactacaacccgtccctcaagagtcgagtcaccatctccgcagacacgtccaagaaccagttctcctgaggctgagctctgtgaccgccgcagacacggctgtctattactgtgcgagaagtgggtctggcagtggctggtacgtggctctcagtggttccgacccgtggggccagggg

SEQ ID NO: 461386 - DNA, 525 bp, Homo sapiens; identical to SEQ ID NO: 447753
  misc_feature: HEFZJCU01C27AN.16.27.C05.1.454.heavy.3.raw

SEQ ID NO: 461387 - DNA, 552 bp, Homo sapiens
  misc_feature: HEFZJCU01BZ4OL.52.53.E09.1.454.heavy.3.raw
  modified_base (480)..(480): a, c, t, g, unknown or other
cgcagtacgacacgaccggtgctcgatttagagagagtgtgttgggttttccttgttgctattttaaaaggtgtccagtgtggagtgcaggtggtggagtctgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttctggggccagggaacccgggtcaccgtctccctcagcctccaccgaacgggcccagtcggtccttccccgtggccnccctcctccaagagccacctcgtggggggcacgagccggcccgtggggcctcgccgtggtccaaggacctta

SEQ ID NO: 461388 - DNA, 517 bp, Homo sapiens
  misc_feature: HEFZJCU01A5W4B.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaagggaggggggaaccagcgggagttccaagtactcctttg

SEQ ID NO: 461389 - DNA, 489 bp, Homo sapiens; identical to SEQ ID NO: 444591
  misc_feature: HEFZJCU01BNWA9.18.70.G04.1.454.heavy.3.raw

SEQ ID NO: 461390 - DNA, 502 bp, Homo sapiens
  misc_feature: HEFZJCU01AIT3Y.51.37.D04.1.454.heavy.3.raw
cgatcgtatacacgaccggtgctcgatttagtagcatactgttgggtttggggagctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaatgaacagcctgagagctgaggacacggctatgttttactgtgcgagagggaactcgattacagcacg

SEQ ID NO: 461391 - DNA, 508 bp, Homo sapiens
  misc_feature: HEFZJCU01BDTCD.14.71.G05.1.454.heavy.3.raw
cgtctagtaccacgaccggtgctcgatttagtgtcgtcgcaagagagaggagcccagccctgggattttcaggtgttttcattcggtgatcaggactgaacagagagaactcaccatggagtttgggctgagctggctttttcttgtggctattttaaaaggtgtgcagtgtgaggtgcagctgttggagtctgggggaggcttggtacagcctggggggtccctgagactctcctgtgcagcctctggattcgtctttagcagctatgccatgagctgggctcgccaggctccagggaaggggctggagtgggtctctgctattcctggcagtggtgatatcgaatactacgcagactccgtgaagggccggttcactgtttccagagacaattccaagaacacactgtatctgcagatgaccagcctgagagccgaggacacggccgtatattactgtgcgaaacgccaagtatttttggagttggttattatacctttgacttcg

SEQ ID NO: 461392 - DNA, 482 bp, Homo sapiens; identical to SEQ ID NO: 444503
  misc_feature: HEFZJCU01AO8EO.7.10.A10.1.454.heavy.3.raw

SEQ ID NO: 461393 - DNA, 503 bp, Homo sapiens
  misc_feature: HEFZJCU01DGL86.4.58.F03.1.454.heavy.3.raw
agcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaagccttgagtggatgggatcgatcaactctggcaatggcaacacaaaatattcacagaaagttacagggcagagtcaccattacccagggacacatccgcgaacacagcctacatggagctgagcagcctgacatctgaagacacggctgtgtattactgttcgagacgggctagtctgggatctagttatagtgactcgtcgttctggggccg

SEQ ID NO: 461394 - DNA, 482 bp, Homo sapiens; identical to SEQ ID NO: 444503
  misc_feature: HEFZJCU01AYTXS.7.10.A10.1.454.heavy.3.raw

SEQ ID NO: 461395 - DNA, 509 bp, Homo sapiens; identical to SEQ ID NO: 457468
  misc_feature: HEFZJCU01BKXKB.4.67.G01.1.454.heavy.3.raw

SEQ ID NO: 461396 - DNA, 532 bp, Homo sapiens
  misc_feature: HEFZJCU01D9EHS.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagaggggagagtggagtagaacgtaaatacgggaaaccgtttgacttttggggcagggaaccctggtcaccggtctcctcagcctccaccaagggcccatccggtcttcccctggcaccctcctccaagagcacctctgggggcacagcggccctggggctgcct

SEQ ID NO: 461397 - DNA, 375 bp, Homo sapiens; identical to SEQ ID NO: 444459
  misc_feature: HEFZJCU01BIB6O.48.59.F04.1.454.heavy.3.raw

SEQ ID NO: 461398 - DNA, 504 bp, Homo sapiens
  misc_feature: HEFZJCU01EWN3V.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaattgttttctgtctatcgtacaatttgataggctctatggactggacttcgtc

SEQ ID NO: 461399 - DNA, 517 bp, Homo sapiens
  misc_feature: HEFZJCU01DPTHR.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaaggcccatcggtcttcccctggcaccctcctccaagagcacctctggggcacagcggccctgggctgcctggtcaaggactacttcctagagacacg

SEQ ID NO: 461400 - DNA, 512 bp, Homo sapiens; identical to SEQ ID NO: 446424
  misc_feature: HEFZJCU01EXHM4.4.39.D06.1.454.heavy.3.raw

SEQ ID NO: 461401 - DNA, 521 bp, Homo sapiens
  misc_feature: HEFZJCU01DW66O.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccagggaccctggtcatcgtctccccagcctccaccaagggcccatcggtcttcccctggccg

SEQ ID NO: 461402 - DNA, 504 bp, Homo sapiens
  misc_feature: HEFZJCU01EXKX7.9.81.H04.1.454.heavy.3.raw
tgatacgtctcacgaccggtgctcgatttagtagtgtagattcgcggggagctctgggagaggagccccagccctgagattcccaggtgttttccattcagtgatcagcactgaacacagaggactcaccatggagttgggactgacctggattttccttttgggtattttaaaaggtgtccagtgtgaagtgcagctggtggagtctgggggaggcttggtgcagcctggcacctccctgagactctcctgtgccgcctctggattcatgtttgatgattatgccatgcactgggtccggcaagttccagggaagggcctggagtgggtctcaggtattacttggagtagcactaccacaggctatgcggactctgtgaggggccgattcaccatctccagagacaacgccaagaactccctatatctgcaaatgaatggtctgagagttgaggacacggccttgtattactgtgcaaaagatggaaaccccaggtggacgct

SEQ ID NO: 461403 - DNA, 530 bp, Homo sapiens
  misc_feature: HEFZJCU01BVDAY.49.16.B05.1.454.heavy.3.raw
  modified_base (509)..(509): a, c, t, g, unknown or other
  modified_base (522)..(522): a, c, t, g, unknown or other
agtcgagagacacgaccggtgctcgatttagagctcacgtatggggtttgggctgagcgtgggttttccgttgttaggctattttaaaaggtgtccagtgtgacgtgcaggtggtggagtctgggggaggcttggtccagcctggggggtccctgacactctcctgtatagtctctggattcaccgtcagtaacaactacatgagttgggtccgccaggctccagggaagggactggagtgggtctcagttatttatagcggtggtgacacatactacgcagactccgtgaagggcagattcaccatctccagagacggtttcaagaacacactctatcttcaaatgaacagcctgagagccgaggacacggctgtgtattactgtgcgagagatcccccgggtatagcagtgtctggtacatattactggggccagggaaccctggtcaccgtctcctcagcctccaccaagggcccatcggtcttcccctggcgccctgctccaggngcacctccgaagngcacagcc

SEQ ID NO: 461404 - DNA, 521 bp, Homo sapiens
  misc_feature: HEFZJCU01BH2TP.12.33.C11.1.454.heavy.3.raw
atacgacgtacacgaccggtgctcgatttagagtgagctcgttgggtttggggggaagaggaagactgacggtccccccaggagttcaggtgctgggcacggtgggcatgtgtgagttttgtcacaagatttgggctcaactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctgggccaagggaccacggtcatcgtctcctcagcctccaccaaggcccatcggtcttcccctcgcaccctcctccaagagcacctctgggggcacagcc

SEQ ID NO: 461405 - DNA, 522 bp, Homo sapiens
  misc_feature: HEFZJCU01EUOHG.48.70.G04.1.454.heavy.3.raw
agtatacatacacgaccggtgctcgatttagtgtagtgtgaagggaaaggggctgggagaggagccccagccttggaattcccaagtgttttcatttcagtgatcaggactgaacacagaggactcaccatggagtttgggctgagctggattttccttgctgctattttaaaaggtgtccagtgtgaggtgcagctggtgcagtccggggggggcctggtaccgcctggggggtcccttagactctcctgtgcagcctctggattcatcttcagtaatgtctggatgacctggttccgccaggctccagggaagggctggagtgggttggccgtgttaaaaccaaagctgagggtgggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactgactagttggggaccg

SEQ ID NO: 461406 - DNA, 498 bp, Homo sapiens
  misc_feature: HEFZJCU01DOPLD.12.55.E11.1.454.heavy.3.raw
atacgacgtacacgaccggtgctcgatttagcactcgcacgttgggtttgggctgagctgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaaggccatcggtcttcccctggcgcctgctcc

SEQ ID NO: 461407 - DNA, 496 bp, Homo sapiens
  misc_feature: HEFZJCU01CZT6L.40.81.H04.1.454.heavy.3.raw
tctagcgactcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccacgtc

SEQ ID NO: 461408 - DNA, 508 bp, Homo sapiens
  misc_feature: HEFZJCU01DN6MN.51.12.B01.1.454.heavy.3.raw
cgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcagggtcatcatgaccggggacacgtccatcgccacaacttacatggaactgaccagtctgacatttgacgacacggccgtctattactgtgcgacagaagcggcggacagaggttcgcttactggttcgaggctctcccca

SEQ ID NO: 461409 - DNA, 538 bp, Homo sapiens
  misc_feature: HEFZJCU01EW3CR.13.40.D07.1.454.heavy.3.raw
tcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccaggggggggcctggagtggcttggaagcatctctcaaagcgggacgaccgactataacccgtcttttaggagtcgagtctcgatttcaatagacaggtctaagacacaattctccctgagggtgacctctatgtcggccgcggacgcggccgtctattactgtgcgcgaggatctccgtcggaacacttcgtgacaaggcaaaacgtccgaagtcgttatcactttgactcctggggccagggaaccctggtcagcgtctcttcagcctccaccaagggcccatcggtcttcccctggcaccctcctccagagcacctctgggggcacagcggccctgggctgcctc

SEQ ID NO: 461410 - DNA, 396 bp, Homo sapiens; identical to SEQ ID NO: 444469
  misc_feature: HEFZJCU01EHOIV.47.46.E02.1.454.heavy.3.raw

SEQ ID NO: 461411 - DNA, 515 bp, Homo sapiens
  misc_feature: HEFZJCU01CMZ7X.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggcccatcggtcttcccctggcaccctcctccaagagcacctctgggggcacagcggcctgggctgcctggtcaaggactatcctagagacacg

SEQ ID NO: 461412 - DNA, 542 bp, Homo sapiens
  misc_feature: HEFZJCU01D0ZVR.48.3.A03.1.454.heavy.3.raw
agtatacatacacgaccggtgctcgatttagagagcgtcacagggggagagaggagcccagccctgggattttcaggtgttttcacttggtgatcaggactgaacagagagaactcaccatggagtttgggctgagcgtgcgttttctacgtggccattttaaaaggtgtccagtgtgaggagcagttgtcggaatctgggggagacctggtacagccgggggggtccctgacactctcctgtgtggcctctggattcatttttagcaaccacgccattacctgggtccgccagagtccagggaagggactggacggagtcgcgggtataagtggttttagtggaagtagattatacgcagagtccgtaaggggccggttcaccatctccagagacaattccaagaacacggcatatctacaatgaacaacctgggcgccgaagacacggccgtctattactgtgcgagatctctactagtgccgcgaggtactttgactctggggtcaggaaccctggtcacgtctcctcagcctcaccac

SEQ ID NO: 461413 - DNA, 514 bp, Homo sapiens
  misc_feature: HEFZJCU01BNH6P.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctggggaggcttggtcaagcctggagggtccctgagactctcctgtgcagcctctggattcgcctctggattgacgttcagtgactactacatgacctgggtccgccaggctccagggaagggctggagtgggtttcatacatttatcctagtggtgataccatatactacgcagactctgtgaagggccgattcaccatctccaggacaacgccaagaactcactgactttgcaatgaacaccctgcgagccgaggacacggccgtatattactgtgcgagaataacccgttcgcctggttatta

SEQ ID NO: 461414 - DNA, 508 bp, Homo sapiens
  misc_feature: HEFZJCU01EXIF5.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctggggccagggaaccctggtcaccgtctcctcagcctccaccaagggcccatcggtcttcccctggcaccctccccaagagcacctctgggggcacagcggccctgggctgcctggtcaaggactacttccgtact

SEQ ID NO: 461415 - DNA, 487 bp, Homo sapiens
  misc_feature: HEFZJCU01A94AK.16.12.B01.1.454.heavy.3.raw
tgtactactccacgaccggtgctcgatttagtagtgtagatttgggcttggaacagcctggggggtccctgagactctcctgtgcaacctctggattcacctttaccagctatgccatgagctgggtccgccaggctccagggaaggggctggagtgggtcgcagccattagtggtattcgtgatgccacatactacgcagactccgtgaggggccggttcaccatctccagcgacacttccaggagcacgttgtatctgcaaatgaacagcctgagagtcgaggacacggccctatattactgtgcgaaagataagatttggggacccgatgcttatgatagctggggccaagggacaatggtcacccgtctcttcagcctccaccaagggcccatcggtcttcccctggcaccctcctccaagagcacctctgggggcacagcggccctgggctgcctggtcaaggactacttccgagtagtaca

SEQ ID NO: 461416 - DNA, 531 bp, Homo sapiens
  misc_feature: HEFZJCU01AR31N.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtagaagggccgattcaccatctcagaagacaattccaggaacacattgtatcttcaaatgaataacctgagagccgaggacacggccatgtattactgtgtggggcatttacttgacccctggggccggggaaccctggtcaccgtctccccaccctccaaccg

SEQ ID NO: 461417 - DNA, 395 bp, Homo sapiens
  misc_feature: HEFZJCU01BZFUS.47.46.E02.1.454.heavy.3.raw
agctcacgtacacgaccggtgctcgatttagactcatctacaggggaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttctacgtgagct

SEQ ID NO: 461418 - DNA, 519 bp, Homo sapiens; identical to SEQ ID NO: 445330
  misc_feature: HEFZJCU01ARAR0.7.78.H01.1.454.heavy.3.raw

SEQ ID NO: 461419 - DNA, 509 bp, Homo sapiens
  misc_feature: HEFZJCU01EJXBU.51.55.E11.1.454.heavy.3.raw
cgatcgtatacacgaccggtgctcgatttagcactcgcacgttgggtttggggacccaaaaaccacacccctccttgggagaatcccctagatcacagctcctcaccatggactggacctggagcatccttttcttggtggcagcagcaacaggtgcccactcccaggttcagctggtacagtctggagctgaagtgaagaagcctggggcctcagtgaaggtctcctgcaaggcctctggttacacctttatgaattatggtatcagctgggtgcgccaggcccctggacaagggcttgagtggatgggatggatcagcgcttacactggtgacacaaagtatgcacagaaactccagggcagagtcaccatcgaccacagacacgtccacgagcacagcctacataggaactgaggagccgtgggatctgacgacacggccgtgtattactgtgcgagagatacggcccgaggggagaggtagttgggttttcaccgtctggcagtt

SEQ ID NO: 461420 - DNA, 396 bp, Homo sapiens; identical to SEQ ID NO: 444433
  misc_feature: HEFZJCU01CX4D5.47.59.F04.1.454.heavy.3.raw

SEQ ID NO: 461421 - DNA, 528 bp, Homo sapiens
  misc_feature: HEFZJCU01C8FK8.10.85.H08.1.454.heavy.3.raw
catagtagtgcacgaccggtgctcgatttagtatcactcagtcgcgggggagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcacatctccagagacaacgccaagaagtcactgtatctgcaaatgaacgatgtgagagtcgaggacacggctgtatatttctgtgcggagggggagccgggctatgggttcggacttcgtggggccacggggaaccctggtctacccg

SEQ ID NO: 461422 - DNA, 493 bp, Homo sapiens; identical to SEQ ID NO: 456873
  misc_feature: HEFZJCU01C9LWX.4.7.A07.1.454.heavy.3.raw

SEQ ID NO: 461423 - DNA, 522 bp, Homo sapiens
  misc_feature: HEFZJCU01DLYX4.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgagggccgattcaccatctccagagacaattccaagaacacgctgtttcttcaaatgaacagcctgagagccgatgacacggccgtgtattactgtgcgagagatggggcccacggaacgttactacgctatggacgtcgtggggccaaggggacccg

SEQ ID NO: 461424 - DNA, 468 bp, Homo sapiens
  misc_feature: HEFZJCU01A0AZM.16.78.H01.1.454.heavy.3.raw
tgtactactccacgaccggtgctcgatttagtgtgagtagtttgggtttgggctcaactctcctgtgcagcctctggattcaccttgagaacttatagcatgaactgggtccgccaggctccagggaaggggctggagtgggtctcatccattagtagtagtagtagttacatatattacgcagactcagtgaagggccgattcaccatctccagagacaacgcccagaactcactatatctgcaaatgaacagcatgagagccgacgacacggctgtgtattactgtgcgggagccgtaacttcgggggactacctcgaccccctggggccagggaatactggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 461425 - DNA, 400 bp, Homo sapiens; identical to SEQ ID NO: 444452
  misc_feature: HEFZJCU01CHE59.47.24.C02.1.454.heavy.3.raw

SEQ ID NO: 461426 - DNA, 487 bp, Homo sapiens; identical to SEQ ID NO: 452507
  misc_feature: HEFZJCU01EJ8XY.51.52.E08.1.454.heavy.3.raw

SEQ ID NO: 461427 - DNA, 505 bp, Homo sapiens
  misc_feature: HEFZJCU01CQNQR.48.23.C01.1.454.heavy.3.raw
agtatacatacacgaccggtgctcgatttagtacacgtgattagggattggggtctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattggggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccgaagggacaatggtcaccgtctt

SEQ ID NO: 461428 - DNA, 516 bp, Homo sapiens
  misc_feature: HEFZJCU01DWHB3.52.71.G05.1.454.heavy.3.raw
cgcagtacgacacgaccggtgctcgatttagtgtcgtcgcaagagagaggggggagagaggagcccagccctgggattttcaggtgttttcatttggtgatcaggactgaacagagagaaatcaccatggagtttgggctgagctggctttttcttgtggctattttaaaaggtggccaatgtgaggtgcagctggtggagtctgggggaggcttggtacagcccggggggtccctgagactctcctgtgcagcctctggattcagttttaccagctatgccatggcctgggtccgccaggctccagggaaggggctggagtgggtctcaggtattagtggtagtgctatgaccacattctacgcagactccgtgaagggccggttcaccatttccagagacaattccaagagtaccctgtatctgcaaatgaacagcctgagagccgacgacacggccgtatattactgtgcgaagcaattactctatggacattatgggacccattgactactc

SEQ ID NO: 461429 - DNA, 512 bp, Homo sapiens
  misc_feature: HEFZJCU01DXTKI.5.23.C01.1.454.heavy.3.raw
atcagacacgcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaattggtggacctgggtccgccagcccccaggaaagaggctggagtggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagaggaccacggtcatcgtctcctcagcctcc

SEQ ID NO: 461430 - DNA, 398 bp, Homo sapiens; identical to SEQ ID NO: 444798
  misc_feature: HEFZJCU01BKEMJ.4.60.F05.1.454.heavy.3.raw

SEQ ID NO: 461431 - DNA, 519 bp, Homo sapiens; identical to SEQ ID NO: 445617
  misc_feature: HEFZJCU01C5QMA.9.34.D01.1.454.heavy.3.raw

SEQ ID NO: 461432 - DNA, 519 bp, Homo sapiens
  misc_feature: HEFZJCU01ET1O6.3.17.B06.1.454.heavy.3.raw
  modified_base (362)..(362): a, c, t, g, unknown or other
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgnacaatacgccgcgtctgtgaaggcagattcaccatctcaagagatgattcagagaactcactttatctgcaaatgaacagcctgagaaccgacgacacggccgtctattattgtgtcattagacctaggatacaacgacggtggtaacctggtattc

SEQ ID NO: 461433 - DNA, 533 bp, Homo sapiens; identical to SEQ ID NO: 450602
  misc_feature: HEFZJCU01DABWD.7.78.H01.1.454.heavy.3.raw

SEQ ID NO: 461434 - DNA, 501 bp, Homo sapiens
  misc_feature: HEFZJCU01BGQAY.9.33.C11.1.454.heavy.3.raw
tgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactacttgacttctgggccagggaaccctggtcaccgtctcctcagcctccaccaagggcccatcggtcttcccctggcgccctgctccaggagcacctccgagaggcacagcggccctgggctgcctggtcaagactacttccagacgtatca

SEQ ID NO: 461435 - DNA, 492 bp, Homo sapiens
  misc_feature: HEFZJCU01AYRG9.11.38.D05.1.454.heavy.3.raw
cgagagataccacgaccggtgctcgatttagtatctgatagttgggtttgggggaggcttggtacagcctggggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagtggtggtagctgctactggggccagggaaccctggtcaccgtctcctcagcctccaccaagggcccatcggtcttccccctggcaccctcctccaagagcaccctctgggggcacagcggccctgggctgcctggtcaaggactactccgtatctctcg

SEQ ID NO: 461436 - DNA, 506 bp, Homo sapiens; identical to SEQ ID NO: 456544
  misc_feature: HEFZJCU01E0WT2.17.10.A10.1.454.heavy.3.raw

SEQ ID NO: 461437 - DNA, 519 bp, Homo sapiens
  misc_feature: HEFZJCU01C73H7.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaaggcccatcggtcttcccctggcaccctcctcccaagagcacctctgggggcacagcggccctgggctgcctggtcaaggactacttcctagagacacg

SEQ ID NO: 461438 - DNA, 524 bp, Homo sapiens
  misc_feature: HEFZJCU01B2A5Z.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggccaggggaccctggtcatcgtctccccagcctccaccaagggcccatccggtcttcccctggccg

SEQ ID NO: 461439 - DNA, 478 bp, Homo sapiens
  misc_feature: HEFZJCU01CIIPK.19.53.E09.1.454.heavy.3.raw
tactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgcattactgtgcaaggagta

SEQ ID NO: 461440 - DNA, 499 bp, Homo sapiens
  misc_feature: HEFZJCU01EPH71.48.34.D01.1.454.heavy.3.raw
agtatacatacacgaccggtgctcgatttagatcgtctgtgttggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgcccgctccaggagcacctccgagagcacagcggccctgggctgcctggtcaaggactacttcctatgtatact

SEQ ID NO: 461441 - DNA, 505 bp, Homo sapiens
  misc_feature: HEFZJCU01BJ36T.9.28.C06.1.454.heavy.3.raw
tgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccactaatggagtgggtgtgggctggatccgtcatcccccaggaaaggccctggaatggcttgcattcgtttattggaatgatgataaacgctacagcccatctctgaggaccaggctcaccattaccaaggacacctccaaaaaccaggtggtccttacaatgaccaacatggaccctgtggacacagccacatattactgtgcacacagtgtcatgactgcggtgactgttctcccctttggctactggggccagggaaccctggtcaccgtctcctcagcctccacc

SEQ ID NO: 461442 - DNA, 524 bp, Homo sapiens; identical to SEQ ID NO: 446153
  misc_feature: HEFZJCU01AXEHK.12.86.H09.1.454.heavy.3.raw

SEQ ID NO: 461443 - DNA, 506 bp, Homo sapiens; identical to SEQ ID NO: 444696
  misc_feature: HEFZJCU01BMBUU.16.34.D01.1.454.heavy.3.raw

SEQ ID NO: 461444 - DNA, 504 bp, Homo sapiens
  misc_feature: HEFZJCU01CZ9JR.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgatctaccactctccacgagacaattaccctacgaacaacggtccgtatcttgcacctcgaccagcctgagaactagacgacacgtctctctactactgtgcgagagagttgacgacgta

SEQ ID NO: 461445 - DNA, 511 bp, Homo sapiens; identical to SEQ ID NO: 450289
  misc_feature: HEFZJCU01BYX9F.3.34.D01.1.454.heavy.3.raw

SEQ ID NO: 461446 - DNA, 525 bp, Homo sapiens
  misc_feature: HEFZJCU01EA2B9.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaaggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagacgacccctccgatagcagtggctggtccactaggtttgactactgggggccaggggaagcgttggtcaccggtctcctcacgcct

SEQ ID NO: 461447 - DNA, 503 bp, Homo sapiens
  misc_feature: HEFZJCU01B8DP3.17.25.C03.1.454.heavy.3.raw
  modified_base (435)..(435): a, c, t, g, unknown or other
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacganacggccgtctattactgtgcgagagtcccacgatccggtgagcctacggcagcggcctttgacttctc

SEQ ID NO: 461448 - DNA, 509 bp, Homo sapiens
  misc_feature: HEFZJCU01CE1SB.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcacggcagttagtcacccatactactttgactactggggccg

SEQ ID NO: 461449 - DNA, 517 bp, Homo sapiens; identical to SEQ ID NO: 445684
  misc_feature: HEFZJCU01DVPJG.9.34.D01.1.454.heavy.3.raw

SEQ ID NO: 461450 - DNA, 514 bp, Homo sapiens
  misc_feature: HEFZJCU01COZAX.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctggggccaaggtacagcggtcaccgtcgcctcagcctccaccaagggcccatcggtcttcccctgcaccctcctccaagagcacctctgggggc

SEQ ID NO: 461451 - DNA, 505 bp, Homo sapiens
  misc_feature: HEFZJCU01D3I7W.48.44.D11.1.454.heavy.3.raw
agtatacatacacgaccggtgctcgatttagcgcagtacgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggcctgggctgcctggtcaaggactacttcctatgtatact

SEQ ID NO: 461452 - DNA, 418 bp, Homo sapiens; identical to SEQ ID NO: 446028
  misc_feature: HEFZJCU01EBL6O.16.28.C06.1.454.heavy.3.raw

SEQ ID NO: 461453 - DNA, 551 bp, Homo sapiens
  misc_feature: HEFZJCU01B9X3Q.49.71.G05.1.454.heavy.3.raw
agtcgagagacacgaccggtgctcgatttagtgtcgtcgcaagagagaggggggagtctccttcaccacccagcggggatctcacggcttccttttctgtcctcctccaggatggggtcaaccgccatcctcgccctcctcctggctgttctccaaggagtctgtgccgaagtgcagctggtgcagcccggagcggtaatgaaaagcccggggagtctctgaggatctcctgtaagggttctggatacagctttagtaccttctggatcacctgggtgcgccagctgcccgggaaaggcctggaatggatggggaggattgaccccagtgactccagtaccaactacagtccgtccttcgaaggccacgtcagcatctcacttgacgtgtccaccaccactgtctacctaccagtgacgcagcctcaagacatcggacaccgccacctacttactgtgcacgacgccgttataccacgaggctggtaccttgactccttcgggggccgacggggcgaccctcgggtcctacccggtcctcccttcctaccg

SEQ ID NO: 461454 - DNA, 519 bp, Homo sapiens
  misc_feature: HEFZJCU01C9VZV.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgatttttcgatccctccgcagtcgacactttgattactggggccgggaacccgtggtcgccgtctcctcagcctccaccaagggcccatcggtcttcccctggcaccctcctccaagagcacctctgggggcacagcggccctgggctgcctggtcaaggactacttccagacgtatca

SEQ ID NO: 461455 - DNA, 523 bp, Homo sapiens
  misc_feature: HEFZJCU01DP0QF.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttctccctgaagctgagctctgtgactgccgcggacacggccgtgtattactgtgcgaggtcgatgtgatggtaacaactgcttcttactcctttgaccagtgggccggggaacccgtggtcaccgtctcttcagcctccaccaagggcccatcggtcttcccctcggcaccctcctcccaagagccacctcctgggggcacgagcc

SEQ ID NO: 461456 - DNA, 511 bp, Homo sapiens
  misc_feature: HEFZJCU01BQGQU.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggtcctttgacttctgggggccaggggacg

SEQ ID NO: 461457 - DNA, 505 bp, Homo sapiens
  misc_feature: HEFZJCU01ELPG4.48.23.C01.1.454.heavy.3.raw
agtatacatacacgaccggtgctcgatttagtacacgtgattagggattgggggcttttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgt

SEQ ID NO: 461458 - DNA, 464 bp, Homo sapiens; identical to SEQ ID NO: 445533
  misc_feature: HEFZJCU01BSXHK.19.10.A10.1.454.heavy.3.raw

SEQ ID NO: 461459 - DNA, 523 bp, Homo sapiens; identical to SEQ ID NO: 445239
  misc_feature: HEFZJCU01D34L0.9.78.H01.1.454.heavy.3.raw

SEQ ID NO: 461460 - DNA, 515 bp, Homo sapiens
  misc_feature: HEFZJCU01BOP0Z.10.87.H10.1.454.heavy.3.raw
catagtagtgcacgaccggtgctcgatttagcagtactgcgttgggtttgggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtctgggggaggcgtggtccagcctggggggtccctgagactctcctgtgcagcctctggattcgacttcgaaatgtctggcatgcactgggtccgccaggctccaacgaaggggctggagtgggtggcagttctttcatttgatgaaaaagggatattatgcgacctccgtgaagggccgattcagcatctccagagacatttccaaggccacggtgtatctgcaaatgaccagcctgagaagtgaggacacggctatgtactattgtgcgaaggaccttccacctgaaactaatatgggggctttgaacactc

SEQ ID NO: 461461 - DNA, 494 bp, Homo sapiens
  misc_feature: HEFZJCU01A91P2.4.26.C04.1.454.heavy.3.raw
agcactgtagcacgaccggtgctcgatttagtctagcgactttgggtttgggggtccctgagactctcctgtacagactctggattcacctttagcagccatgccatgagctgggtccgccaggctccagggaaggggctggagtgggtctcagcaattagtggaggtggtggtggtggtacatactacgcaaactccgtgaggggccgattcaccatctccagagacaattccaagaacacgttatatctgcaaatgaacagcctgcgagccgacgacacggccgtatattactgtgcgaaatgccttattgcgaccgagcgtagcagtggctggtgcaactggctcgacccctggggccagggaacccatgtcaccgtctcctcagcctccaccaagggccatcggtcttcccctggcgccctgctccagagcacctccgagaacacagcggccctgggctgcctggtcaaggactacttccctacagtgct

SEQ ID NO: 461462 - DNA, 523 bp, Homo sapiens
  misc_feature: HEFZJCU01C0562.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgactttgggccagggaaccctggtcaccgtctcctcagcctccaccaacgggcccatcggtcttcccctggccaccctcctccaagagccacctctgggggcacagccggccc

SEQ ID NO: 461463 - DNA, 508 bp, Homo sapiens; identical to SEQ ID NO: 446331
  misc_feature: HEFZJCU01AUPXC.51.5.A05.1.454.heavy.3.raw

SEQ ID NO: 461464 - DNA, 483 bp, Homo sapiens; identical to SEQ ID NO: 444639
  misc_feature: HEFZJCU01EPNI3.11.23.C01.1.454.heavy.3.raw

SEQ ID NO: 461465 - DNA, 509 bp, Homo sapiens
  misc_feature: HEFZJCU01EOHOL.51.65.F10.1.454.heavy.3.raw
cgatcgtatacacgaccggtgctcgatttagctacgctctaagggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggattaattccaaaagtggtggcacaaagactagcacagaagtttcagggcagggtcacatgaccagggacaagtccaccaacacagcctacatggaactaaggggactgacatctgacgacacggccatgtattattgtgcgagagaaatgttagtactgtcgtttgggtccgtggggcccgggaacccgggtcg

SEQ ID NO: 461466 - DNA, 507 bp, Homo sapiens
  misc_feature: HEFZJCU01C25YN.14.78.H01.1.454.heavy.3.raw
cgtctagtaccacgaccggtgctcgatttagtgtgagtagtttgggtttgggggaggcttggtcaagcctggagggtccctgagactctcctgtgcagcctctggattcaccttcagtgactactacatgacctggatccgccaggcgccagggaaggggctggaatggattgcatacattcactatagtggaaatgcagtgtcctacgcagactctctgaagggccgattcaccgtctccagggacaacgccaagaactcgctgtatctgcaaatcgacggcctgagagtcgaggacacggccatgtattactgtgcgagagtgtggttcggtcatgttttagaagttgggggcttttgaccactggggccagggaaccctggtcaccgtctcttcagcctccaccaagggcccatcggtcttcccctggcaccctcctccaagagcacctctgggggcacagcggccctgggctgcctggtcaaggactacttccgtactagacg

SEQ ID NO: 461467 - DNA, 477 bp, Homo sapiens; identical to SEQ ID NO: 444659
  misc_feature: HEFZJCU01DOD1U.16.10.A10.1.454.heavy.3.raw

SEQ ID NO: 461468 - DNA, 491 bp, Homo sapiens; identical to SEQ ID NO: 444749
  misc_feature: HEFZJCU01BTYYE.11.13.B02.1.454.heavy.3.raw

SEQ ID NO: 461469 - DNA, 491 bp, Homo sapiens; identical to SEQ ID NO: 447981
  misc_feature: HEFZJCU01EMA8B.47.85.H08.1.454.heavy.3.raw

SEQ ID NO: 461470 - DNA, 511 bp, Homo sapiens
  misc_feature: HEFZJCU01A70M0.52.78.H01.1.454.heavy.3.raw
cgcagtacgacacgaccggtgctcgatttagtgtgagtagtttgggtttggggggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggattgttgtcgtttggcacc

SEQ ID NO: 461471 - DNA, 354 bp, Homo sapiens
  misc_feature: HEFZJCU01DZ3FO.3.66.F11.1.454.heavy.3.raw
agacgcactccacgaccggtgctcgatttagtcacgcgagaaggggctggagtgggtcgcaattacttatgacggtcgttacatacactacgcagactccgtgaggggcagattcaccatctccagagacaattccatgaacacggtctatcttcaaatgaacagcctgagagtcgaggacacggctgtatattattgtgtccactaccaattgggacagggaaccctggtcaccgtctcctcagcctccaccaagggcccatcggtcttccccctggcgccctgttccaggagcacctccgagagcacagcggccctgggctgcctggtcaaggactacttccgagtgcgtct

SEQ ID NO: 461472 - DNA, 499 bp, Homo sapiens
  misc_feature: HEFZJCU01C1YUC.48.62.F07.1.454.heavy.3.raw
agtatacatacacgaccggtgctcgatttagtagtcgcataaagggaaaggggtctgagagaggagccttagccctggattccaaggcctatccacttggtgatcagcactgagcaccgaggattcaccatggaactggggctccgctgggttatccttgttgctattttagaaggtgtccagtgtgaggtgcagctggtggagtcagggggaggcctggtcaagcctggggggtccctgagactctcctgtgcagcctctggattcaccttcagtacctataccatgaactgggtccgccaggctccagggaaggggctggagtgggtctcatccattagtagtagcagtaattatatagacgacgcagactcagtgaaggccgattcaccatctccagagacaacgccaagcactcactgtatctccaaatgaacagcctgagagccgacgacacggctgtgtattactgtgcgagacttgggagagagtgggacct

SEQ ID NO: 461473 - DNA, 524 bp, Homo sapiens
  misc_feature: HEFZJCU01CHCAA.49.33.C11.1.454.heavy.3.raw
agtcgagagacacgaccggtgctcgatttagagtgagctcgttgggtttgggctgagcgtggtttcgtgtaggctatttaaaaggtgtccagtgtgacgtgcaggtggtggagtctgggggaggcttggtccagcctggggggtccctgacactctcctgtatagtctctggattcaccgtcagtaacaactacatgagttgggtccgccaggctccagggaagggactggagtgggtctcagttatttatagcggtggtgacacatactacgcagactccgtgaagggcagattcaccatctccagagacggtttcaagaacacactctatcttcaaatgaacagcctgagagccgaggacacggctgtgtattactgtgcgagagatcccccgggtatagcagtgtctggtacatattactggggccagggaacccctggtcaccgtctcctcagcctccaccaagggcccatcggtcttcccctggcgccctgctccaggagcacctccgagagcacagcc

SEQ ID NO: 461474 - DNA, 533 bp, Homo sapiens
  misc_feature: HEFZJCU01D3S2H.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccgggggaaccctggtcaccgtcctccccacccctccacccg

SEQ ID NO: 461475 - DNA, 390 bp, Homo sapiens; identical to SEQ ID NO: 444541
  misc_feature: HEFZJCU01CA3AZ.16.24.C02.1.454.heavy.3.raw

SEQ ID NO: 461476 - DNA, 503 bp, Homo sapiens
  misc_feature: HEFZJCU01EPWFQ.48.73.G07.1.454.heavy.3.raw
agtatacatacacgaccggtgctcgatttagctctacgctcagggcacgaccggtgctcgatttagagtgctacgaagggaaaggggctgggagaggagccccagccctgagaatcccaggtgtttccattcagtgatcagcactgaacacagaggactcaccatggagttgggactgagctggattttccttttgactattttaaaaggtggtcactgtgaacggctactggtggagtctgggggaggcttggtacagcctggcaggtccctgaaactctcctgtgtagcctctggattcaggttgggcgattatgccatgcaatgggtccggcaaggtccagggaagggcctggagtgggtctcaggcatcgattggaaagcgagaagattgactatgcggagtctgtgaagggcgattcatcatctccagagacaacgccaagaactccctgtattgcagatgaacaatctgagacctgacgacacggccttgtattatt

SEQ ID NO: 461477 - DNA, 359 bp, Homo sapiens
  misc_feature: HEFZJCU01EZ4RH.11.12.B01.1.454.heavy.3.raw
cgagagataccacgaccggtgctcgatttagtagtgtagatttgggttttccttgttgctattttaaaagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggccaagggaccacggtcaccgtctcctcagcctccaccaagggcccatcggtcttccccctggcgccctgctccaggagcacctccgagagcacagcggccctgggctgcctggtcaaggactacttccgtatctctcg

SEQ ID NO: 461478 - DNA, 512 bp, Homo sapiens
  misc_feature: HEFZJCU01CXDP9.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctctttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtattggaaatgaacagcctaagtcctgaggacacgggtgtatactactgtacgaaggaggggggaacaggcggagtccaagtactcc

SEQ ID NO: 461479 - DNA, 481 bp, Homo sapiens
  misc_feature: HEFZJCU01CFKI8.49.27.C05.1.454.heavy.3.raw
agtcgagagacacgaccggtgctcgatttagacgcgatcgaagggtttggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctgaagacacggctgtatattactgtgcgaactt

SEQ ID NO: 461480 - DNA, 481 bp, Homo sapiens
  misc_feature: HEFZJCU01ATFSB.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccagagcacctctgggggcacagcggccctgggctgcctggtcaaggactacttcctagagacacg

SEQ ID NO: 461481 - DNA, 525 bp, Homo sapiens
  misc_feature: HEFZJCU01C7YWV.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctgggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctcccaccctccaccaaggcccatcggtcttcccctggcaccctcctccaagagcacctctgggggcacagcggccctgggctgcctggtcaaggactacttcccatactcgta

SEQ ID NO: 461482 - DNA, 400 bp, Homo sapiens; identical to SEQ ID NO: 444452
  misc_feature: HEFZJCU01ARG42.47.24.C02.1.454.heavy.3.raw

SEQ ID NO: 461483 - DNA, 507 bp, Homo sapiens
  misc_feature: HEFZJCU01D3FMF.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaacccaggtggtccttacaatgaccaatatggaccctgtggacacagccacatattactgttcacgctctatggttcggggagttattagtccctactttgactactggggccaggggaactctggtcaccgtctccgcagcctccacc

SEQ ID NO: 461484 - DNA, 401 bp, Homo sapiens; identical to SEQ ID NO: 448437
  misc_feature: HEFZJCU01C3G3H.11.70.G04.1.454.heavy.3.raw

SEQ ID NO: 461485 - DNA, 380 bp, Homo sapiens; identical to SEQ ID NO: 445304
  misc_feature: HEFZJCU01BP516.3.26.C04.1.454.heavy.3.raw

SEQ ID NO: 461486 - DNA, 506 bp, Homo sapiens
  misc_feature: HEFZJCU01A9RUN.48.81.H04.1.454.heavy.3.raw
agtatacatacacgaccggtgctcgatttagtagtgtagattcgcggggatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcgcggggaggtggacggagctcggttttcgggagtttatcatctactactttg

SEQ ID NO: 461487 - DNA, 534 bp, Homo sapiens; identical to SEQ ID NO: 446321
  misc_feature: HEFZJCU01ANX2C.22.38.D05.1.454.heavy.3.raw

SEQ ID NO: 461488 - DNA, 511 bp, Homo sapiens
  misc_feature: HEFZJCU01DR5K4.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaaggaggggggaaccgagcgggagttccaagtactccttt

SEQ ID NO: 461489 - DNA, 524 bp, Homo sapiens
  misc_feature: HEFZJCU01EJV50.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcctttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccacgcctccacgacggcccatcggtccttccccgtggccg

SEQ ID NO: 461490 - DNA, 477 bp, Homo sapiens; identical to SEQ ID NO: 444659
  misc_feature: HEFZJCU01CQF1W.16.10.A10.1.454.heavy.3.raw

SEQ ID NO: 461491 - DNA, 493 bp, Homo sapiens; identical to SEQ ID NO: 455531
  misc_feature: HEFZJCU01DR0JJ.47.85.H08.1.454.heavy.3.raw

SEQ ID NO: 461492 - DNA, 528 bp, Homo sapiens
  misc_feature: HEFZJCU01AEB38.51.67.G01.1.454.heavy.3.raw
cgatcgtatacacgaccggtgctcgatttagagtatacatattgggtttgggggctctgagagaggagcccagccctgggattttcaggtgttttcatttggtgatcaggactgaacagagagaactcaccatggagtttgggctgagctggctttttcttgtggctattttaaaaggtggccagtgtgaggtgcagctgttagagtctgggggaggcttggtccagcctgggggtccctcagactctcctgtgcagcctcgggaattatatttaagaactttgccatgagttgggtccgccaggctccagggaaggggctggaatgggtctccactattagtggcagcggtgatgacacattctacacagactccgtgaggggccgtttcgaccatctccagagacaatgccaaagacacgctctatctggaagtgaagagcctgagagtcgaggacacggccgtcttttattgtgtgaaggggcgtggggacttattctttcaggaccatatttactttgactttc

SEQ ID NO: 461493 - DNA, 500 bp, Homo sapiens
  misc_feature: HEFZJCU01B1I55.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttcccctggcgccctgctccaggagcacctccgagacgcacagcggccctgggctgcctggtcaaggacttaccg

SEQ ID NO: 461494 - DNA, 506 bp, Homo sapiens
  misc_feature: HEFZJCU01AMUA1.11.6.A06.1.454.heavy.3.raw
cgagagataccacgaccggtgctcgatttagatctactgacagggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtctgggggaggcttggtaaagccgggggggtcccttagactctcctgtgcagcctctggcatcactttcagtgacgcctggatgagctgggtccgccaggctccagggaaggggctggagtgggttggccgtattaaagcgaggctgctggtgggacaacagactacgctgcacccgtgaagggcagattcaccatctccagagatgattcaaggagcacagtgtttctacaaatgaacagcctgactgccgggggacactgccgtgtattactgtgccagcagcagcacctggccactatatttctttcg

SEQ ID NO: 461495 - DNA, 391 bp, Homo sapiens; identical to SEQ ID NO: 444514
  misc_feature: HEFZJCU01D5KI4.12.24.C02.1.454.heavy.3.raw

SEQ ID NO: 461496 - DNA, 488 bp, Homo sapiens
  misc_feature: HEFZJCU01DZFNX.11.13.B02.1.454.heavy.3.raw
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctgtcaggactactccgtatctctcg

SEQ ID NO: 461497 - DNA, 527 bp, Homo sapiens
  misc_feature: HEFZJCU01CM76W.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactccctgtacagcctctggattcactttcagtaaggcctggatgaactggtccgccaggctccagggaaggggctggagtgggttggccgtattaaaaccaaactgatggtgggacaacagactacgctgcacccgtgaaaggcagattcaccatctcaagagatgattcaaaaagcacgctgtatctgcaaatgaacagcctgagaaccgaggacacagccgtgtacttactgtaccacactccctagaagcgtacaactactactactacgtatggacctc

SEQ ID NO: 461498 - DNA, 514 bp, Homo sapiens
  misc_feature: HEFZJCU01AMYCF.14.66.F11.1.454.heavy.3.raw
cgtctagtaccacgaccggtgctcgatttagtcacgcgagaagggtgccagggggaagaccgatgggcccaggactggtgaagccttcggagaccctgtccctcacctgcactgtctctggcggctccatcaatacttacaactggacctggatccggcagcccccagggaagggtctgaattggattgggtatatctctaacagtgggaggaccaactacaacccctcctccagagtcgagtcaccatttcattagacacgtccaagaaccagttctccctgaggttgaactctgtgaccgctgcggacacggccgtgtattattgtgcgagggtcggtggccacaatggcgagtacaactggttcgaccctggggccagggaaccctggtcaccgtctcctcagcctccaccaagggcccatcggtcttcccctggcaccctcctccaagagcacctctgggggcacagcggccctgggctggcctggtcaaggacacttccgtactagacg

SEQ ID NO: 461499 - DNA, 506 bp, Homo sapiens
  misc_feature: HEFZJCU01BLME7.13.79.H02.1.454.heavy.3.raw
tcacgtactacacgaccggtgctcgatttagtgtcacacgaagggaaagggggtctcagagaggagccttagccctggactccaaggcctttccacttggtgatcagcactgagcacagaggactcaccatggaattggggctgagcgtgggttttccttgttgctattttagaaggtgtccagtgtgaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagttggaagtgagaaatactatgtggactctgtgaagggccgattcaccatctccagagacaacgccaagaactcactgtatctgcaaatgaacagcctgagagccgaggacacggctgtctattctgtgcgagagattggggcggaaggtatagcagtgg

SEQ ID NO: 461500 - DNA, 501 bp, Homo sapiens; identical to SEQ ID NO: 453820
  misc_feature: HEFZJCU01BSNBP.3.20.B09.1.454.heavy.3.raw

SEQ ID NO: 461501 - DNA, 498 bp, Homo sapiens
  misc_feature: HEFZJCU01DJN1I.7.85.H08.1.454.heavy.3.raw
cgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctggggggtccctgagactctcctgtgcagcctctggatttaccttcagtacttatggcatgaactgggtccgccaggctccagggaagggctgcagtgggtttcacacattaatactggaagtaggaccataacttacacagactctgtgaagggccgattcaccacctccagagacgacgccaagaactcactgtctctgcaatgaacagcctgagagtcgaggacacggctgtgtattactgtgcgagagatccgggaggggactatgacc

SEQ ID NO: 461502 - DNA, 502 bp, Homo sapiens
  misc_feature: HEFZJCU01A4X10.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtctggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgtcttttgatatctggggccaagggact

SEQ ID NO: 461503 - DNA, 514 bp, Homo sapiens
  misc_feature: HEFZJCU01BBOYZ.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggactttcgtggggccagggtaacccg

SEQ ID NO: 461504 - DNA, 497 bp, Homo sapiens
  misc_feature: HEFZJCU01DK8WV.3.67.G01.1.454.heavy.3.raw
  modified_base (457)..(457): a, c, t, g, unknown or other
agacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaagtaagactgctggtgagacaacagactacgctgctgccttcagaggcagattcaccatcttcagagatgaatcacagagcactctgtttctgcaaatgaacagcctggaanacgcggacacagccatgtatttattgtacattaggacact

SEQ ID NO: 461505 - DNA, 465 bp, Homo sapiens; identical to SEQ ID NO: 444805
  misc_feature: HEFZJCU01AHH6Y.19.10.A10.1.454.heavy.3.raw

SEQ ID NO: 461506 - DNA, 524 bp, Homo sapiens
  misc_feature: HEFZJCU01EFAZG.11.25.C03.1.454.heavy.3.raw
cgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaatgaacagcctgagagccgatgacacggccgtgtattactgtgcgagagatggggcccacgaacgttactacgctatggacgtctggggccaagggaccac

SEQ ID NO: 461507 - DNA, 508 bp, Homo sapiens
  misc_feature: HEFZJCU01CTAHV.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatgacagcctaagagttgaggacacggctgtttattactgtacgaaagaggggggagtacgagtggcagctccaagtacttac

SEQ ID NO: 461508 - DNA, 415 bp, Homo sapiens; identical to SEQ ID NO: 444794
  misc_feature: HEFZJCU01EWXT6.14.74.G08.1.454.heavy.3.raw

SEQ ID NO: 461509 - DNA, 518 bp, Homo sapiens; identical to SEQ ID NO: 446027
  misc_feature: HEFZJCU01BXIDL.9.34.D01.1.454.heavy.3.raw

SEQ ID NO: 461510 - DNA, 523 bp, Homo sapiens
  misc_feature: HEFZJCU01DW7P6.16.67.G01.1.454.heavy.3.raw
tgtactactccacgaccggtgctcgatttagagtatacatattgggtttggggagctctgagagaggagcccagccctgggatttccaggtgttttcatttggggatcaggactgaacagagagaactcaccatggagttagggctgagctggctttttcttgtggctattttaaaaggtgtccagtgtgaggtgcagctgttggagtctgggggaggcttggtacagcctggggggtccctgagactctcctgtgcgacctctggattcacctttagcagctatgccatgagctgggtccgccaggctccagggaagggctggagtgggtctcaactattagtggtagtggtggtaccacatacttcgctgactccgtgaagggccggttctccatctccagagacacttccaagaacacggtgtatctgcaagtgcacagcctgagagccggaggacacggccatatattactgtgcgaaagatacgtaccttcccctcgtagagagtggactaaactaaa

SEQ ID NO: 461511 - DNA, 508 bp, Homo sapiens; identical to SEQ ID NO: 445890
  misc_feature: HEFZJCU01AWI3J.10.12.B01.1.454.heavy.3.raw

SEQ ID NO: 461512 - DNA, 487 bp, Homo sapiens
  misc_feature: HEFZJCU01ECAAB.49.4.A04.1.454.heavy.3.raw
agtcgagagacacgaccggtgctcgatttagagtagtgatcaggggctctgggagaggagcccagcactagaagtcggcggtgcttccattcgatgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgctgcctctggattcaccttcagggtctatgacatgcactgggtccgccaggctccaggcaaggggctggagtgggtggcatttatctcatatgatggaagcaagatatactacattgactccgtgaagggccgattcatcatctccagagacaactccgagaacacactgtatcttcaaatgaacaggttgagagctgaagacaacggtcttatattactgtgacgtaacttaactcaac

SEQ ID NO: 461513 - DNA, 483 bp, Homo sapiens
  misc_feature: HEFZJCU01A43W4.51.6.A06.1.454.heavy.3.raw
  modified_base (422)..(422): a, c, t, g, unknown or other
cgatcgtatacacgaccggtgctcgatttagatctactgacaggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagcctgggaggtccctgagactctcctgtgaagcctctggattcagcttcagtacgtatggtttgcgctgggtccgccaggctccaggcaagggactgcagtgggtggcatctatatcatatgaaggaagcaataaatactacgcagactccgtgaagggccgattcaccatctccagagacaatcccaagaacacactttanctgcaaatgaacaccctgagacttgagacacggctgtctattatgtgcgagagggagatcg

SEQ ID NO: 461514 - DNA, 513 bp, Homo sapiens
  misc_feature: HEFZJCU01D9G7V.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggaccacctccacaaaccaggtggtccttacaatgaccaatatggaccctgtggacacagccacatattactgttcacgctctatggttcggggagttattagtccctactttgactactgggccagggaactctggtcaccgtctccgcagcctccaccaagggccc

SEQ ID NO: 461515 - DNA, 540 bp, Homo sapiens
  misc_feature: HEFZJCU01B2XDM.13.57.F02.1.454.heavy.3.raw
tcacgtactacacgaccggtgctcgatttagctcgatatagttgggtttggggtgggaaatactttctgagactcatggacctcctgcacaagaacatgaaacacctgtggttcttcctcctcctggtggcagctcccagctgggtcctgtcccaggtgcagctgcaggagtcgggcccaggactggtgaagccttcggggaccctgtccctaaattgcgctgtctctggtgactccatcagcggtagtaaatggtggagttgggtccgccagcccccagggaaggggctggagtggattggggaaatctttcatagcgggatcaccaactacaacccgtccctcaagagtcgagtcaccatatctatagacaagtccaagaaccacttctccctgaacgtgagttctgtgaccgccgcggacacggccgtgtattactgtgcgagaggattgtggttttactctggttcaatgagttattatgtctttgactagttggggccagggaaccctgggtcaccgtctcctcacgcctccacc

SEQ ID NO: 461516 - DNA, 482 bp, Homo sapiens
  misc_feature: HEFZJCU01AQG96.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctggcgccctgctccaggagcacctccgagagcacagcggccctgggctgcctggtcaaggactacttcccatactatg

SEQ ID NO: 461517 - DNA, 426 bp, Homo sapiens; identical to SEQ ID NO: 456107
  misc_feature: HEFZJCU01AVVXV.9.34.D01.1.454.heavy.3.raw

SEQ ID NO: 461518 - DNA, 502 bp, Homo sapiens
  misc_feature: HEFZJCU01ERZ7L.12.53.E09.1.454.heavy.3.raw
atacgacgtacacgaccggtgctcgatttagagagagtgtgttggggggagatgtggtccggcctggggggtccctgagactctcctgtgcagcctctcgattcagcttcagtaactatgctatgcactgggtccgccaggctccaggcagggggctggagtgggtggcagttatatcatatgatggaagacataaatactacgcagactccgtgaagggccgattcaccctctccagagacaattccaagaatacgctgtatatgcaaatgaacagcctgagacctgaggacacggctatgtattactgtgcgagaggaccattttggaatgcttattataccggaaacgcttttgatatttggggccaagggacaatggtcaccgtctcttcagcctccaccaacgggccatcggtcttcccctggcaccctcctccaagagcacctctgggggcacagcggcctgggctgcctggtcaaggactactcctacgtcgtat

SEQ ID NO: 461519 - DNA, 502 bp, Homo sapiens
  misc_feature: HEFZJCU01CT6FQ.12.2.A02.1.454.heavy.3.raw
atacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgagtggatgggatggatcagcgcttacaatggtaacacagactatgcacagaagttccaggacagagtcaccatgaccacagacacatccacgagcacagcctacatggagctggaggagcctgagatctgacgacacggccgtgtattactgtgcggagaggttttagtgattacttatttgtagtggtggttacctgcttactttttc

SEQ ID NO: 461520 - DNA, 526 bp, Homo sapiens
  misc_feature: HEFZJCU01A3ZAM.16.39.D06.1.454.heavy.3.raw
tgtactactccacgaccggtgctcgatttagtgacatctcgcagttctttgggttttggggagaggagcccagcactgggattccgaggtgtttccattcagtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccagggaaggggccggaatgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagtcttttgactacg

SEQ ID NO: 461521 - DNA, 512 bp, Homo sapiens
  misc_feature: HEFZJCU01CY5NL.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgcctgctccaggagcacctctgggggcacagcggccctgggctgcctggtcaaggactacttcccatacc

SEQ ID NO: 461522 - DNA, 541 bp, Homo sapiens
  misc_feature: HEFZJCU01EOB2I.48.38.D05.1.454.heavy.3.raw
agtatacatacacgaccggtgctcgatttagtatctgatagttgggtttggggacttttccaatttttttgggggccagcgctgggtctcttgccaagagaaccccggagtagttgggggggctcaggaacctgccctaagacaacagcgtccacacagacgaggggctacgggtcctcacagacgaagggcacggggtccagatgatccctcctcctggccccgccacctcgtctctttctgcggccaggcgcactctgggcctctggggtcaagtggccggcaaccccgggccctccccggcctctgtctcagagagtcccagggacgtggcggggcgccggttcttccctggggtcctggcgttgttgtcaccttgtgtcacctgtttcgacccctgggcccagggagccctggtcaccgtctccttagcctccaccaagggcccatcggtcttccccctggcgccctgctccaggagcacctccgagagcacagcggccctgggctgcctggtcaaggactacttcctatgtatact

SEQ ID NO: 461523 - DNA, 413 bp, Homo sapiens
  misc_feature: HEFZJCU01D99I0.51.60.F05.1.454.heavy.3.raw
cgatcgtatacacgaccggtgctcgatttagtacgtcatcagggaaagggactggagtggattggatatatctattacaatgggaggaccgactacaacccctccctcaagagtcgagtcaccatatcagttgactcgtccaagaagcagttctccctgaagctgaactctgtgaccgctgcggacacggccgtgtatttctgtgcgaaagttcaggccccatattattatgacagtagtgtttatcaaataggggcctactttgaccactggggccggggaaccctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 461524 - DNA, 517 bp, Homo sapiens
  misc_feature: HEFZJCU01EMTX8.7.78.H01.1.454.heavy.3.raw
  modified_base (488)..(488): a, c, t, g, unknown or other
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccaagagcacctctgggggcacagcggccctgggcngcctggtcaaggctactcctagagacacg

SEQ ID NO: 461525 - DNA, 509 bp, Homo sapiens
  misc_feature: HEFZJCU01DJPZ2.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattgggggagcgactggttcgacccctggggccagggaaccctggtcaccgtctcctcagcctccaccaagggcccatcggtcttcccctggcaccctcctccaagagcacctctgggggcacagcggcctgggctgcctggtcaaggactacttcctacgtcgtat

SEQ ID NO: 461526 - DNA, 485 bp, Homo sapiens
  misc_feature: HEFZJCU01CH3S5.8.39.D06.1.454.heavy.3.raw
ctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcgagggcagagtctccatgaccagtgacacgtccgcgagcactgtctatatggagatgaggagcctgagacttgacgacacggccgtatattactgtgcgagaatcgaagaaggtggctac

SEQ ID NO: 461527 - DNA, 522 bp, Homo sapiens
  misc_feature: HEFZJCU01C0FTR.9.34.D01.1.454.heavy.3.raw
  modified_base (478)..(478): a, c, t, g, unknown or other
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaaactccgtgaggggccgcttcatcatctccagagacaattccccagaacatactgtctctgcaactcaataacctgagaggcgaggacacggccatttatttctgtgcgaaggaggcatatgggaatacgatttttcgatccctccgcagtcgacactttgattactggggccggggaaccctggtcgccgtctcctcagcctccaccaagggcccatcggtcttccccctggcaccctcctccaagagcacctctgggggcacancggccctgggctgcctggtccaagacgtacttccagacgtatca

SEQ ID NO: 461528 - DNA, 506 bp, Homo sapiens
  misc_feature: HEFZJCU01ET046.51.65.F10.1.454.heavy.3.raw
cgatcgtatacacgaccggtgctcgatttagctacgctctaagggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggattaattccaaaagtggtggcacaaagactgcacagaagtttcagggcagggtcaccatgaccagggacaagtccaccaacacagcctacatggaactaaggggactgacatctgacgacacggccatgtattattgtgcgagagaaatgttaggtactgctttgggtccctggggcccgggaaccgggtc

SEQ ID NO: 461529 - DNA, 528 bp, Homo sapiens
  misc_feature: HEFZJCU01DYTU4.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggcccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctggggccggggaaccctggtcaccgtctccccaccctccaccg

SEQ ID NO: 461530 - DNA, 497 bp, Homo sapiens; identical to SEQ ID NO: 445179
  misc_feature: HEFZJCU01EZKCC.12.55.E11.1.454.heavy.3.raw

SEQ ID NO: 461531 - DNA, 373 bp, Homo sapiens
  misc_feature: HEFZJCU01EFGXA.7.37.D04.1.454.heavy.3.raw
cgtgtctctacacgaccggtgctcgatttagtagcatactgttgggtttgggtggccgaaatcaccggagatggaggtgtgcaatactatgcggactctgtgaggggccgattcactgtctccagagacaacaccaagaactcactgtatctgcaaatgaacagcctgagagtcgaggacagtggtgtatattactgtgcgagccccggcgcttttgggcggaattcgggactgtggggccagggaaccctggtcagcgtctcagcctccaccaagggcccatcggtcttccccctggcgccctgctccaggagcacctccgagagcacagcggccctgggctgcctggtcaagactacttcctagagacacg

SEQ ID NO: 461532 - DNA, 396 bp, Homo sapiens; identical to SEQ ID NO: 444731
  misc_feature: HEFZJCU01DTN1K.18.61.F06.1.454.heavy.3.raw

SEQ ID NO: 461533 - DNA, 493 bp, Homo sapiens; identical to SEQ ID NO: 455531
  misc_feature: HEFZJCU01A97ZL.47.85.H08.1.454.heavy.3.raw

SEQ ID NO: 461534 - DNA, 483 bp, Homo sapiens; identical to SEQ ID NO: 444639
  misc_feature: HEFZJCU01C1FN9.11.23.C01.1.454.heavy.3.raw

SEQ ID NO: 461535 - DNA, 514 bp, Homo sapiens
  misc_feature: HEFZJCU01B9H9W.12.1.A01.1.454.heavy.3.raw
atacgacgtacacgaccggtgctcgatttagacgtctcatcagggggggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagtagtagttattactactggggctggatccgccagcccccaggggaggggctgaagtggattgggagtgtctattatagtgggatcacctactacaacccgtccctcaagagtcgagtcaccatatccgtcgacacgtccaagaaccagttctccctgaagctgagctctgtgaccgccgcagacacggctgtgtattactgtgcgagacagccaagacagattttggagtggttactgttggactactttgactacgtggggccaggggaaccctggtcc

SEQ ID NO: 461536 - DNA, 464 bp, Homo sapiens; identical to SEQ ID NO: 445533
  misc_feature: HEFZJCU01DSVGS.19.10.A10.1.454.heavy.3.raw

SEQ ID NO: 461537 - DNA, 527 bp, Homo sapiens
  misc_feature: HEFZJCU01CAW4M.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactgggccagggaaccctggtcaccgtctcctcagcctccaccga

SEQ ID NO: 461538 - DNA, 505 bp, Homo sapiens
  misc_feature: HEFZJCU01CNARN.47.55.E11.1.454.heavy.3.raw
agctcacgtacacgaccggtgctcgatttagcactcgcacgttgggtttggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcggacttctggggcaggaacct

SEQ ID NO: 461539 - DNA, 381 bp, Homo sapiens
  misc_feature: HEFZJCU01AIHHF.2.86.H09.1.454.heavy.3.raw
acgctcgacacacgaccggtgctcgatttagtgctatagacttggggtttgggatggatcaacgctaagagtggtggcacaaactatgcacagaaatttcagggcagggtcaccatgaccagggacacgtcccacagacacagcctacatggagctgaggagactgagatctgacgacacggccgtgtattattgtttcactcgaccagtggttacacaaggtcccgactttgactcctggggccagggaaccctggtcaccgtctcctcagcctccaccaagggcccatcggtcttccccctggcgccctgctccaggagcacctccgagagcacagcggccctgggctgcctggtcaaggactacttcctgtcgagcgt

SEQ ID NO: 461540 - DNA, 518 bp, Homo sapiens
  misc_feature: HEFZJCU01CRLMF.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtcccccaacacagggactgcagtggattggatacatctacttcagtgggaaccccaactaccaacccctccctcaggagtccagtcgccatatccctggactcgtccaacaaccagatctccctgacgatgacatctgtgaccgctgcggacacagccgtttattactgtgcgcgatctgggcgactcagtgactatggtatggacgtctggggccaagggaccacggtcatcgtctcctcagcctccaccaacgggcccatcggtcctttcccccgtggcc

SEQ ID NO: 461541 - DNA, 518 bp, Homo sapiens
  misc_feature: HEFZJCU01ER1BP.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccagggaccg

SEQ ID NO: 461542 - DNA, 481 bp, Homo sapiens; identical to SEQ ID NO: 445006
  misc_feature: HEFZJCU01C3XMO.7.10.A10.1.454.heavy.3.raw

SEQ ID NO: 461543 - DNA, 524 bp, Homo sapiens
  misc_feature: HEFZJCU01D81K7.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtgaattgactactgggccagggaaccctggtcaccgtctcctcagcctccacc

SEQ ID NO: 461544 - DNA, 463 bp, Homo sapiens; identical to SEQ ID NO: 446208
  misc_feature: HEFZJCU01EGEXD.19.10.A10.1.454.heavy.3.raw

SEQ ID NO: 461545 - DNA, 496 bp, Homo sapiens; identical to SEQ ID NO: 444697
  misc_feature: HEFZJCU01D8CT3.16.37.D04.1.454.heavy.3.raw

SEQ ID NO: 461546 - DNA, 468 bp, Homo sapiens
  misc_feature: HEFZJCU01B0UH6.48.7.A07.1.454.heavy.3.raw
agtatacatacacgaccggtgctcgatttagcacgtgtcgcaggggcagggtgtacacctgtggttctcggggctgtcctttggttttggagatggttttctcgatggggggctgggatggctcaacgctgacgatggtcaaacaaaatattcacagcaattccagggcagactctcccttaccagggacacttccgcgaacacaggctacatgtttttgagcagactgacatctaaagacacggctatttactactgtgcgagaggcggattttgtcggcgtggtgattgttacagtcagaatcgtcgattgtggttcgacccctggggccagggaaccctgctctccgtctcctcagcttccaccaagggcccatcggtcttccccctggcgccctgctccaggagcacctctgggggcacagcggccctgggctgcctggtcaaggactacttcctatgtatact

SEQ ID NO: 461547 - DNA, 371 bp, Homo sapiens; identical to SEQ ID NO: 444919
  misc_feature: HEFZJCU01AHLSW.3.1.A01.1.454.heavy.3.raw

SEQ ID NO: 461548 - DNA, 486 bp, Homo sapiens
  misc_feature: HEFZJCU01EJK1H.51.14.B03.1.454.heavy.3.raw
cgatcgtatacacgaccggtgctcgatttagtgtgagtagtttgggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactgggccagggaaccctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 461549 - DNA, 502 bp, Homo sapiens
  misc_feature: HEFZJCU01A65F1.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtctgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcggacttctgggcac

SEQ ID NO: 461550 - DNA, 538 bp, Homo sapiens
  misc_feature: HEFZJCU01EIYLR.17.28.C06.1.454.heavy.3.raw
  modified_base (371)..(371): a, c, t, g, unknown or other
  modified_base (524)..(524): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtcccagagactctcctgtgcagcctccggattccccttcagtagttattggatgacttgggtccgccagactccagggaaggggctggagtgggtggccaacataaagcaagatggaactgccgagttttacgnggactctgtgaagggccgtttcaccatctccagagacaacgccaagaattcactgtatctacaactgaacagcctgagagtcgcagacacggccgtgtattactgtgcgagatgtggaaaaagtatggctgtgtttattgggggccaggggancccgtggtctaccg

SEQ ID NO: 461551 - DNA, 520 bp, Homo sapiens
  misc_feature: HEFZJCU01ASIQ3.17.33.C11.1.454.heavy.3.raw
cgtagactagcacgaccggtgctcgatttagagtgagctcgttgggtttgggctcaactctcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctccaccaagggcccatcggtcttcccctggcaccctcctccagagcacctctggggcacagcggccctgggctgcctggt

SEQ ID NO: 461552 - DNA, 422 bp, Homo sapiens; identical to SEQ ID NO: 444734
  misc_feature: HEFZJCU01DJ5UN.16.78.H01.1.454.heavy.3.raw

SEQ ID NO: 461553 - DNA, 490 bp, Homo sapiens
  misc_feature: HEFZJCU01DF92W.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccagagcacctccgagagcacagcggccctgggctgcctggtcaggactacttccgtactctctcg

SEQ ID NO: 461554 - DNA, 520 bp, Homo sapiens
  misc_feature: HEFZJCU01EFSX3.12.11.A11.1.454.heavy.3.raw
  modified_base (507)..(507): a, c, t, g, unknown or other
atacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagagtctcctgtacaacctctggattcatgtttagtagtcattggatgaactgggtccgccaggctccagggaaggggctggagtgggtggccaacataaagcaagatggaagtgagaaatactatgtggactctgtgaagggccgattcacaatctccagagacaacgccaagaactcactgtatctgcaaataaacagcctgaaagccgaggacacggctgtgtatttctgtgcgaggacgtcctacggtgaacaatttatacaaaccngaacaaagtttcg

SEQ ID NO: 461555 - DNA, 438 bp, Homo sapiens
  misc_feature: HEFZJCU01DFGDI.19.25.C03.1.454.heavy.3.raw
tactctcgtgcacgaccggtgctcgatttagtagtgtagatttgggtttggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctccgcggctttgtcttggcattatgcacctccacgccgtccacgtaccagttgaacttgacctcagggtcttcgtggctcacgtccaccaccacgcatgtgacctcaggggtccgggagatcatgagggtgtccttgggttttggggggaagaggaagactgacggtcccccaggagttcaggtgctgggcacagcggccctgggctgcctggtcaaggactacttccacgagagta

SEQ ID NO: 461556 - DNA, 527 bp, Homo sapiens
  misc_feature: HEFZJCU01ANKM3.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggccagggaaccctggtgaccgtctcctcagcctccaccaagggcccatcggtcttcccctggcgccctgctccaggagcacctccgagagcacagcggcccctgggccg

SEQ ID NO: 461557 - DNA, 511 bp, Homo sapiens
  misc_feature: HEFZJCU01DL2BH.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgtttctgacaatagaacagcctgagaattgaggacgtcgggtatatactactgtgcccgtcgacccctgactgataaaccggaacgtcggttcgaccccgtcggggccgtagggaacccgtcggtcaccgtctcct

SEQ ID NO: 461558 - DNA, 385 bp, Homo sapiens; identical to SEQ ID NO: 453182
  misc_feature: HEFZJCU01BX27O.18.60.F05.1.454.heavy.3.raw

SEQ ID NO: 461559 - DNA, 502 bp, Homo sapiens
  misc_feature: HEFZJCU01DC05H.10.38.D05.1.454.heavy.3.raw
catagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcacctctccagagacacttccaacaacatcttgtattcttcacatgcacaatctgagagtcgacgacacggccacctattattgtgcgcgacatgactacgctcaattctggggccg

SEQ ID NO: 461560 - DNA, 379 bp, Homo sapiens; identical to SEQ ID NO: 444450
  misc_feature: HEFZJCU01EKXV9.47.77.G11.1.454.heavy.3.raw

SEQ ID NO: 461561 - DNA, 509 bp, Homo sapiens
  misc_feature: HEFZJCU01CJRCV.7.71.G05.1.454.heavy.3.raw
cgtgtctctacacgaccggtgctcgatttagtgtcgtcgcaagagagagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgaggcagtgttcaatggtatgcagactccgtgaagggccgattcaccatctccagagacaattccaggaacacaatgtatttggaaatgaacagcctaagtcctgaggacacgggtgtatactactgtacgaaggagggggaacgagcgggagtccagtactcctttg

SEQ ID NO: 461562 - DNA, 485 bp, Homo sapiens
  misc_feature: HEFZJCU01CAXEE.52.8.A08.1.454.heavy.3.raw
cgcagtacgacacgaccggtgctcgatttagcatactctacagggggctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatgggaagcaagatatactatgtagactccgtgaagggccgattcatcatctccagagacaactccgagaacacgctgtatctgcaaatgaacaggctgagagctgaagacgacggctgtattattactgtgcgtaacttaacg

SEQ ID NO: 461563 - DNA, 502 bp, Homo sapiens
  misc_feature: HEFZJCU01EGWCN.48.59.F04.1.454.heavy.3.raw
agtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgtatgctttgatatgtgggccaagggacaatggtcaccgt

SEQ ID NO: 461564 - DNA, 508 bp, Homo sapiens
  misc_feature: HEFZJCU01C5DNM.4.33.C11.1.454.heavy.3.raw
agcactgtagcacgaccggtgctcgatttagagtgagctcgttgggtttgggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctgggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgcgcgtctgtgaaggcagattcatcatctcaagagatgattccaacggcatcgcctatctgcagatgaacagcctgagaccgaggacacagccgtctattactgtgttagggagttttacgattttggta

SEQ ID NO: 461565 - DNA, 504 bp, Homo sapiens
  misc_feature: HEFZJCU01B9ECK.13.12.B01.1.454.heavy.3.raw
tcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaagggccgattcgccatctccagagacaattccaggaacacgctgtacctggagatggacggcctgagacctgacgacacggcaatttattactgtgcgagggtttatgtgttggaacgtggtacaccggaaaactggttcgacccctggggccagggaaccctggtcgtcgtctcgtctgcctccaccaagggcccatcggtcttcccctggcgccctgctccaggagcacctccgacgagcacagcggccctgggctgcctcggtcaaggactacttccgtacttacgacg

SEQ ID NO: 461566 - DNA, 375 bp, Homo sapiens
  misc_feature: HEFZJCU01C8WY8.49.53.E09.1.454.heavy.3.raw
agtcgagagacacgaccggtgctcgatttagagagagtgtgttgggtttgggggggagaggagcccagcactgggattccgaggtgtttccattcagtgatctgcactgaacacagaggactcgccatggagtttgggctgagctgggttttccttgttgctattttaaaaggtgtccagtgtgatgtgcaggtggtggagcccgggtatagcagtgtctggtacatattactggggccagggaaccctggtcaccgtctcctcagcctccaccaagggcccatcggtcttccccctggcgccctgctccaggagcacctccgagagcacagcggccctgggctgcctggtcaaggactacttcctctctcgact

SEQ ID NO: 461567 - DNA, 505 bp, Homo sapiens
  misc_feature: HEFZJCU01AXKRZ.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggctgcaacagactacggtggcaactcctatgcttttgatatctggggccaagggacaatggtcaccgtctcttcagcctccaccaagggcccatcggtcttcccctcggcaccctcctccaagagcacctctgggggc

SEQ ID NO: 461568 - DNA, 520 bp, Homo sapiens
  misc_feature: HEFZJCU01BCHO4.2.85.H08.1.454.heavy.3.raw
acgctcgacacacgaccggtgctcgatttagtatcactcagtcgcggggccctgggagcacagctcatcaccatggactggacctggaggttcctctttgtggtggcagcagctacaggtgtccagtcccaggtccagctggtgcagtctggggctgaggtgaagaagcctgggtcctcggtgagggtctcctgcaaggcttctggaggcaccttcaggacctatattatgacctgggtgcgacaggcccctggacaagggcttgagtggctggggggatcatccctatgtttggtgaagcaaattacgcacagaagttccggggaagagtctcgattaccgcggacgaatccacgaacacagcctacatggaagtgaccagcctgagatctgaagacacggccgtgtattactgtgcgaagtcgtattactatgatactggtgatttatttgtaatttcgactcctaccactacggtatggacgtctggggccgaggggaccacggtcaccgtctcttc

SEQ ID NO: 461569 - DNA, 481 bp, Homo sapiens
  misc_feature: HEFZJCU01ERE2B.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctggcaccctcctccaagagcacctctgggggcacagcggccctgggctgcctggtcaggactacttccgtatctctcg

SEQ ID NO: 461570 - DNA, 516 bp, Homo sapiens
  misc_feature: HEFZJCU01B46NJ.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaaggagggggaaccgagcgggagttccaagtactcctttg

SEQ ID NO: 461571 - DNA, 509 bp, Homo sapiens
  misc_feature: HEFZJCU01A55VN.15.67.G01.1.454.heavy.3.raw
  modified_base (500)..(500): a, c, t, g, unknown or other
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccagggaaggggctggagtgggtggccaacataaacaagacggagtcagaaaactatgtggactctgtgaacggccgattcaccatctccagagacaacgccaagaattcactgtatttgcaaatgaacagcctgagaggcgaggacacggccgtgtattattgtgcgcgagatgatagtagactctacagtancagggtgta

SEQ ID NO: 461572 - DNA, 506 bp, Homo sapiens
  misc_feature: HEFZJCU01EOUWH.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcttgtttgttttggccggtgaactactggggccagggcaccctggtcaccgtctcctcagcttccaccaagggcccatcggtcttcccctggcgcctgctcaggagcacctctggggcacagcgccctgggctgcctggtcaggactacttccactac

SEQ ID NO: 461573 - DNA, 506 bp, Homo sapiens
  misc_feature: HEFZJCU01CG15N.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggtccagggaaccctggtcatcgtctcctcagcctccaccaagggcccatcggtcttcccctggcaccctcctccaagagcacctctgggggcacagcggccctggctgcctggtcaaggactacttccgagtagtaca

SEQ ID NO: 461574 - DNA, 508 bp, Homo sapiens
  misc_feature: HEFZJCU01ANGR9.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccagggacct

SEQ ID NO: 461575 - DNA, 493 bp, Homo sapiens
  misc_feature: HEFZJCU01CNAJK.48.59.F04.1.454.heavy.3.raw
agtatacatacacgaccggtgctcgatttagtacacacacttagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgccttgatatgtgggcaagggacaat

SEQ ID NO: 461576 - DNA, 483 bp, Homo sapiens
  misc_feature: HEFZJCU01BCH7J.19.67.G01.1.454.heavy.3.raw
tactctcgtgcacgaccggtgctcgatttagagtatacatattgggcttggtccagcctgggcggtcgtctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctggtggacagatcactggggccaggggaaccctggtcaccgtctcctcagcctccaccaagggcccatcggtcttcccctggccgccctgctccaggagcacctccgagagcacagcggccctgggctgcctggtcaaggactacttcccacgagagta

SEQ ID NO: 461577 - DNA, 524 bp, Homo sapiens
  misc_feature: HEFZJCU01BO7YY.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggccagggaaccctggtgaccgtctcctcagcctccaccaagggcccatcggtcttcccctggcgccctgctccaggagcacctccgagagcacagcggccctgggc

SEQ ID NO: 461578 - DNA, 386 bp, Homo sapiens
  misc_feature: HEFZJCU01BP3PM.19.86.H09.1.454.heavy.3.raw
tactctcgtgcacgaccggtgctcgatttagtgctatagacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttccccctggcgccctgctccaggagcacctccgagagcacagcggccctgggctgcctggtcaaggacacttcccacgagagta

SEQ ID NO: 461579 - DNA, 518 bp, Homo sapiens
  misc_feature: HEFZJCU01BT7K6.3.26.C04.1.454.heavy.3.raw
agacgcactccacgaccggtgctcgatttagtctagcgactttgggtttgggctgacctgggttttcctcgttgctcttttaagaggtgtccagtgtcaggtgcagctggtggagtctggggggaggcgtggtccagcctgggaggtccctgagactctcctgtgcagcctctgaattcaccttcagtaattatgctatgcactgggtccgccaggctccgggcaaggggccggagtgggtggcagttatatcttatgatggaaagagtgagtactacgcagactccgtgcagggccgatttatcatctccagagacagtctcaagaacaccctatatctgcaaatgaacagcctgagacctgaggacacggctctatattactgtgcgagagaggcgtcgggaccgatagccgtggctgggacttttgactactggggccagggaaccctggtcaccatctcctcagcctccaccaagggcccatccggtcttccccctcggcaccctcctccaaga

SEQ ID NO: 461580 - DNA, 521 bp, Homo sapiens
  misc_feature: HEFZJCU01D3OZZ.49.37.D04.1.454.heavy.3.raw
agtcgagagacacgaccggtgctcgatttagtagcatactgttgggtttgggtagttgggtttggggggaagaggaagactgacggtcctcccaggagttcaggtgctgggcaccgtgggcatgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttacaaatgaacactctgagacgtgaggacacggctgtctattactgtgcgactgagatgtcttattacgatgccagtgtctttagtaccgttcgaccccgtggggccagggagccctggtcaccgtcctcctcagcttccacaacgggccatcggtcttcccctggcgcctgctcca

SEQ ID NO: 461581 - DNA, 400 bp, Homo sapiens; identical to SEQ ID NO: 444452
  misc_feature: HEFZJCU01API2G.47.24.C02.1.454.heavy.3.raw

SEQ ID NO: 461582 - DNA, 507 bp, Homo sapiens
  misc_feature: HEFZJCU01CV19Y.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtccttcccctggcgccctgctccaggagcacctccgagagcacagcggcc

SEQ ID NO: 461583 - DNA, 519 bp, Homo sapiens; identical to SEQ ID NO: 445330
  misc_feature: HEFZJCU01EZ92R.7.78.H01.1.454.heavy.3.raw

SEQ ID NO: 461584 - DNA, 384 bp, Homo sapiens; identical to SEQ ID NO: 444454
  misc_feature: HEFZJCU01DGYPB.11.61.F06.1.454.heavy.3.raw

SEQ ID NO: 461585 - DNA, 514 bp, Homo sapiens
  misc_feature: HEFZJCU01CW9N4.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtcccccaacacagggactgcagtggattggatacatctacttcagtgggaaccccaactacaacccctccctcaggattccagtcgccatatccctggactcgtccaacaaccagatctccctgacgatgacatctgtgaccgctgcggacacagccgtttattactgtgcgcgatctgggcgactcagtgactatggtatggacgtctggggccaagggaccacggtcatcgtctcctcagcctccaccaagggcccatcggtcttccccctggcta

SEQ ID NO: 461586 - DNA, 487 bp, Homo sapiens
  misc_feature: HEFZJCU01CP240.51.14.B03.1.454.heavy.3.raw
cgatcgtatacacgaccggtgctcgatttagtgtgagtagtttgggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtccttcccctggcaccctcctccaagagcacctctgggggcacagcggccctgggctgcctggtcaaggactacttcctcgtagcact

SEQ ID NO: 461587 - DNA, 518 bp, Homo sapiens; identical to SEQ ID NO: 461172
  misc_feature: HEFZJCU01C1R5E.9.34.D01.1.454.heavy.3.raw

SEQ ID NO: 461588 - DNA, 515 bp, Homo sapiens
  misc_feature: HEFZJCU01AMUTI.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaggcccatcgtcttcccctggcaccctcctccaagagcacctctgggggcacagcggccctgggctgcctggtcaaggactacttcctagagacacg

SEQ ID NO: 461589 - DNA, 508 bp, Homo sapiens
  misc_feature: HEFZJCU01EPFX1.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccaggggaaccctggtcatcgtctcctcagcctccaccaagggcccatcggtcttccccctggcaccctcctccaagagcacctctgggggcacagcggccctgggctgcctggtcaaggactacttccgagtagtaca

SEQ ID NO: 461590 - DNA, 510 bp, Homo sapiens
  misc_feature: HEFZJCU01A5OWP.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctgggggccagggaaccctggtcaccgtctcctcagcctccaccaagggcccatcggtcttcccctggcaccctcctccaagagcacctctgggggcacagcggccctgggctgcctggtcaaggactacttcctacgtcgtat

SEQ ID NO: 461591 - DNA, 527 bp, Homo sapiens
  misc_feature: HEFZJCU01CG5JO.12.86.H09.1.454.heavy.3.raw
  modified_base (504)..(504): a, c, t, g, unknown or other
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtatggttatcctgaatactgggccaggaacctggtgaccgtctcctcagcctccaccaagggcccatcggtcttcccctggcgccctgctccaggagcacctccgagngcacgagccggccctcgggtccg

SEQ ID NO: 461592 - DNA, 522 bp, Homo sapiens
  misc_feature: HEFZJCU01BTS2D.48.53.E09.1.454.heavy.3.raw
agtatacatacacgaccggtgctcgatttagagagagtgtgttgggtttgggggctttctgagagtcatggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactgggcctggatccgccagcccccgggaagggactggaatggattgggagtatctattatacagggagcacctactacaacccgtccctcaagagtcgagtcaccatctccgcagacacgtccaagaaccagttcctccctgaggctgagctctgtgaccgccgcagacacggctgtctattactgtgcgagaagtgggtcgtggcagtggctggtacgtggctctcagtggttccgaccccgtgggggcccaggggataccgtggtctaccc

SEQ ID NO: 461593 - DNA, 508 bp, Homo sapiens
  misc_feature: HEFZJCU01ADS4D.48.81.H04.1.454.heavy.3.raw
agtatacatacacgaccggtgctcgatttagtagtgtagattcgcgggatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcgcggggaggtggacggagctcggttttcggagttatcatctactactttgaatcg

SEQ ID NO: 461594 - DNA, 507 bp, Homo sapiens; identical to SEQ ID NO: 446095
  misc_feature: HEFZJCU01DD8FN.10.38.D05.1.454.heavy.3.raw

SEQ ID NO: 461595 - DNA, 514 bp, Homo sapiens
  misc_feature: HEFZJCU01BMH2X.51.26.C04.1.454.heavy.3.raw
cgatcgtatacacgaccggtgctcgatttagtctagcgactttgggtttggggctgggagacgagcccagcactggaagtcgccggtgtttccattcggtgatcatcactgaacacagacatggagtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaatgaacagcctgagagctgaggacagggctgtttattactgtgtgcgatccgacctcactggtacggggagttacttcctccgcaacggtat

SEQ ID NO: 461596 - DNA, 501 bp, Homo sapiens; identical to SEQ ID NO: 447719
  misc_feature: HEFZJCU01EIOEM.17.10.A10.1.454.heavy.3.raw

SEQ ID NO: 461597 - DNA, 517 bp, Homo sapiens
  misc_feature: HEFZJCU01CPWRW.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctagttattgtgtgagagttttatggcgatgggctgggtggacagatcactggggccac

SEQ ID NO: 461598 - DNA, 490 bp, Homo sapiens
  misc_feature: HEFZJCU01A6MEL.49.34.D01.1.454.heavy.3.raw
agtcgagagacacgaccggtgctcgatttagatcgtctgtgttgggtttgggaggtccctgagactctcctgtgtagtctctggattcaccttcagggtctatgacatgcactgggtccgccaggctccaggcaaggggctggagtgggtggcagttatatcaaatgatgcaagtaacaaatactatgtagactccgtgaagggccgattcaccatctccagagacaattccaagaatacgctgtatctgcacatgaacagcctgagagccgaagacacgggtgtttattactgtgcgaacttaattacggaggacaacggtaaccccgtccgcacggtacggacgtctggggccaagggaccacggtcaccgtctcctcagcctccaccaagggcccatcggtcttcccccggcaccctcctccaagagcacctctgggggcacagcggccctgggctgcctggtcaaggactacttcctctctcgact

SEQ ID NO: 461599 - DNA, 529 bp, Homo sapiens
  misc_feature: HEFZJCU01DAGNA.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactactgggggttcgaccccgtggggccgagggaacccgtggtcaccgtctcctcagcctccaccg

SEQ ID NO: 461600 - DNA, 511 bp, Homo sapiens
  misc_feature: HEFZJCU01DM7LX.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggcccggttcaccatctccagagacaattccaagaacacactgtatctgcaaatgaacagcctgagagccgacgacacggccatatattactgtgcgaaagcaccggcagttagtcacccatactactttgactactgggccac

SEQ ID NO: 461601 - DNA, 524 bp, Homo sapiens
  misc_feature: HEFZJCU01D0L1C.12.40.D07.1.454.heavy.3.raw
atacgacgtacacgaccggtgctcgatttagtgatagagcgtaacaacagagggctcaccatggagtttgggctgagcgtgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcgaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttcccctggccg

SEQ ID NO: 461602 - DNA, 503 bp, Homo sapiens
  misc_feature: HEFZJCU01EB1HX.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactact

SEQ ID NO: 461603 - DNA, 502 bp, Homo sapiens
  misc_feature: HEFZJCU01D6OVT.49.80.H03.1.454.heavy.3.raw
agtcgagagacacgaccggtgctcgatttagctgtgcgtcgaaggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttccccctggcaccctcctccaagagcacctctgggggcacagcggcctgggctgcctggtcaaggactacttcctct

SEQ ID NO: 461604 - DNA, 495 bp, Homo sapiens
  misc_feature: HEFZJCU01AXA3C.48.39.D06.1.454.heavy.3.raw
agtatacatacacgaccggtgctcgatttagtgacatctcgcagttctttgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtggggccagggacaagt

SEQ ID NO: 461605 - DNA, 494 bp, Homo sapiens
  misc_feature: HEFZJCU01DUGN6.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagctttgatctctgggcaagggacactggtcaccgtctcttcagcctccaccaggccatcggtcttccccgtgcgcctgctcc

SEQ ID NO: 461606 - DNA, 518 bp, Homo sapiens; identical to SEQ ID NO: 444718
  misc_feature: HEFZJCU01EZ89U.9.34.D01.1.454.heavy.3.raw

SEQ ID NO: 461607 - DNA, 517 bp, Homo sapiens
  misc_feature: HEFZJCU01BI84H.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaacccgtggtcgccgtctcctcagcctccaccaagggcccatcggtcttcccctggcaccctcctccaagagccacctctgggggcacagcggccctgggctgcctgtcaagactacttccagacgtatca

SEQ ID NO: 461608 - DNA, 522 bp, Homo sapiens
  misc_feature: HEFZJCU01APT7I.12.40.D07.1.454.heavy.3.raw
atacgacgtacacgaccggtgctcgatttagtgatagagcgtaacacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactagtgggggcttgttcgtggggccaggggaccctggtcatcgtctccccagcctccaccaagggcccatcggtcttcccctggcg

SEQ ID NO: 461609 - DNA, 524 bp, Homo sapiens
  misc_feature: HEFZJCU01EGJMT.16.10.A10.1.454.heavy.3.raw
tgtactactccacgaccggtgctcgatttagcgtcgatctcagggtctttcggtgggctcacgtccaccaccaccgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctcaagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctctgggggcacagcggccctgggctgcctggtcaaggactacttccgagtagtacta

SEQ ID NO: 461610 - DNA, 513 bp, Homo sapiens
  misc_feature: HEFZJCU01BJR7W.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtaatcttcaaataaacagtctgagacttgaggacacgggctgtctattactgtgcgagagactacggtgaccttttctggtatttcgatctctggggccgtggcaccctggtcactgtctcctcggcttccaccagggcccatcggtcttcccctggcgcctgctccaggagcacctctggggcacagcggcccg

SEQ ID NO: 461611 - DNA, 510 bp, Homo sapiens
  misc_feature: HEFZJCU01CDMQ4.48.4.A04.1.454.heavy.3.raw
agtatacatacacgaccggtgctcgatttagagtagtgatcaggggagtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttctcctgaaactgaccgctgtgatcgccgcggacacggctgtgtattactgtgcgagacgaatgggcgggtggctacgacttgacttttgggccagggaaacctggtcaccgtctccccagcttccaccaacggccc

SEQ ID NO: 461612 - DNA, 508 bp, Homo sapiens
  misc_feature: HEFZJCU01EG1C0.51.56.F01.1.454.heavy.3.raw
cgatcgtatacacgaccggtgctcgatttagcagacgtctgaacacacaaagggggagcatcacccagcaaccacatctgtcctctagagaaccccctgagagccccgctcctcaccatggactggacctggaggatcctcttcttggtggcagcagccacaagagcccaatcccaggtgcaggtggtgcagtctggggctgaggtgaagaagcccggggcctcagcgaaggtctcctgcaagacctctggctacaccttcagtggcaacaacgtccactgggtgcgccaggcccctggacaaggacttgagtggatgggatggtttagtctgagaactggtgccgcaaattatgcacaggagtttcggggcagggtcgtcatgaccggggacacgtccatcgccacgacttacatggaactgaccagtctgacatttgacgacacggccgtctattactgtgcgacagaagcggcggacagaggttcgcttactggttcgaggctcc

SEQ ID NO: 461613 - DNA, 486 bp, Homo sapiens
  misc_feature: HEFZJCU01AQ1HA.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcgtcttcccctggcgcctgctccagagcacctccgagagcacagcggccgtgggctgcctggtcaaggactacttcctacgtgagct

SEQ ID NO: 461614 - DNA, 533 bp, Homo sapiens
  misc_feature: HEFZJCU01DM6TL.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtccttagactccctgtacagcctctggattcactttcagtaaggcctggatgaactgggtccgccaggctccagggaaggggctggagtggttggccgtattaaaaccaaaactgatgggtgggacaacagactacgctgcacccgtgaaaggcagattcaccatctcaagagatgattcaaaagcacgctgtatctgcaatgaacagcctgagaacgaggacacagccgtgtattactgtaccacactccctgaaagcgtcaactactactactacggtatggacctctggggaccg

SEQ ID NO: 461615 - DNA, 520 bp, Homo sapiens
  misc_feature: HEFZJCU01CVH9U.10.30.C08.1.454.heavy.3.raw
catagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatctgggggagccttggtacagcctggcgggtccctgagactctcctgtacagtctctggattcacctctgatgattatgccatgcactgggtccggcaagctccagggaagggcctggagtgggtctctggaatcacttacaatagtgatttccttaaatatgcggactctgtgagggggcgtttcaccatctccagagacaacgccaggaactccctctatctacaaatgaacagtctgagacctgaggacacggccttatatttctgtgcaaaagatcttggagctggccgtgaccatggggccagggaacccct

SEQ ID NO: 461616 - DNA, 526 bp, Homo sapiens
  misc_feature: HEFZJCU01ANEDF.48.35.D02.1.454.heavy.3.raw
agtatacatacacgaccggtgctcgatttagcacacgatagttgggtttggggggaagaggaagactgacggtccccccaggagttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagaagggttttactatggttcggggagtctccgacccagcaactggttcgaccccgtgggccagggaaccctggtcaccgtctcctcagcctccaccaagggcccatcggtcttccccctggcaccctcctccaagagcacctctggggcacg

SEQ ID NO: 461617 - DNA, 500 bp, Homo sapiens; identical to SEQ ID NO: 446033
  misc_feature: HEFZJCU01A7272.11.27.C05.1.454.heavy.3.raw

SEQ ID NO: 461618 - DNA, 521 bp, Homo sapiens
  misc_feature: HEFZJCU01EA0ZR.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccactaggtttgactactggggccagggaagctttggtcaccgtctcctcagcct

SEQ ID NO: 461619 - DNA, 566 bp, Homo sapiens
  misc_feature: HEFZJCU01BERI0.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacagtcgacctagtgttaattacgtgtgggtgggacttaacgttttactaccggtacccggtcggggggaccccgggtaaccgtcggtacctaccggtccctaccccctacccctaccccg

SEQ ID NO: 461620 - DNA, 354 bp, Homo sapiens
  misc_feature: HEFZJCU01BJMXD.47.38.D05.1.454.heavy.3.raw
agctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctggggcacagcggccctggctgcctggtcaaggactacttcctacgtgagct

SEQ ID NO: 461621 - DNA, 527 bp, Homo sapiens
  misc_feature: HEFZJCU01DYCBT.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaagggctggaatgggtctcagttattcataccgacggtaccatatatgacgcagactccgtgaagggccgattcaccatctccagagaccattccaagaacaccctatatcttcaaatgaacaacctgagagtcgaagacacggccgtatattactgtgcgagacatgactttcggtcgacccctgggggccgaggggaaaccctggtcacccgtctcctcacgg

SEQ ID NO: 461622 - DNA, 519 bp, Homo sapiens; identical to SEQ ID NO: 445330
  misc_feature: HEFZJCU01BKW1A.7.78.H01.1.454.heavy.3.raw

SEQ ID NO: 461623 - DNA, 489 bp, Homo sapiens
  misc_feature: HEFZJCU01EHHYE.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggccccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgccctgctccaggagcacctccgagagcacagcggccctgggctgcctggtcaggactacttcccatactcgta

SEQ ID NO: 461624 - DNA, 516 bp, Homo sapiens
  misc_feature: HEFZJCU01DVDKK.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtaggagtctgggggaggcttggtccagcctggagggtccctaagactctcctgtgcagcctctggactcaccttcacgctcaatggccactacgtggactgggtccgccaggctccagggaaggggctggagtggggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtgtcatagacctaggatacaacgacggtggtacctggt

SEQ ID NO: 461625 - DNA, 513 bp, Homo sapiens
  misc_feature: HEFZJCU01A7TM5.51.56.F01.1.454.heavy.3.raw
cgatcgtatacacgaccggtgctcgatttagcagacgtctgaacacacaaagggggagcatcacccagcaaccacatctgtcctctagagaaccccctgagagccccgctcctcaccatggactggacctggaggatcctcttcttggtggcagcagccacaagagcccaatcccaggtgcaggtggtgcagtctggggctgaggtgaagaagcccggggcctcagcgaaggtctcctgcaagacctctggctacaccttcagtggcaacaacgtccactgggtgcgccaggccccctggacaaggacttgagtggatgggatggtttagtctgagaactggtgccgcaaattatgcacaggagttttcggggcagggtcggtcatgaccgggggacacgtccatcgccacgacttacatggaactgaccagtctgacatttgacgacacggccgtctattactgtgcgacagaagcggcggacagaggttcgcttactggttcgaggctccc

SEQ ID NO: 461626 - DNA, 503 bp, Homo sapiens
  misc_feature: HEFZJCU01DOYK6.10.35.D02.1.454.heavy.3.raw
catagtagtgcacgaccggtgctcgatttagcacacgatagttgggtttgggggaggcttggttaagccgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccacccaagggcccatcggtcttcccctcggcgccctgctccaggagcacctccgagagcacagcggccctgggctgcctgtcaggactacttcccactactatg

SEQ ID NO: 461627 - DNA, 531 bp, Homo sapiens; identical to SEQ ID NO: 446857
  misc_feature: HEFZJCU01B7FO7.7.78.H01.1.454.heavy.3.raw

SEQ ID NO: 461628 - DNA, 562 bp, Homo sapiens
  misc_feature: HEFZJCU01E2BUR.12.40.D07.1.454.heavy.3.raw
atacgacgtacacgaccggtgctcgatttagtgatagagcgtaacaacagagggctcaccatggagtttgggctgagcgtgggttttccgtcgttagctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcggagagagacacacgaacctactggccaatactactgggggcgttgttcgtgggggtccgagggggacccgtcggtccgatccggtcgttcccccaacgccctccacccaaacgggccccgaatccggtctttcccccttcggccgcccctc

SEQ ID NO: 461629 - DNA, 490 bp, Homo sapiens
  misc_feature: HEFZJCU01A4JUU.49.76.G10.1.454.heavy.3.raw
  modified_base (441)..(441): a, c, t, g, unknown or other
  modified_base (469)..(469): a, c, t, g, unknown or other
  modified_base (484)..(484): a, c, t, g, unknown or other
agtcgagagacacgaccggtgctcgatttagtcactcatacaggggggggagaggagcccagcactagaagtcggcggtgtttccattcggtgatcagcactgaacacagaggactcaccatggagtttgggctgagcggtggtttcgtcgtaggcgtctttaagtaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaagggggctggagtggggtggcagttatatcatatgatggaagcaatatatactatgtagactccgtgaagggccgattcatcatctccagagacaagttccgagaacaacgctgatctgcaaatgaacagcctgngagctgaggacacggctgtgtatctgtncgaactaatcacggnggaacg

SEQ ID NO: 461630 - DNA, 497 bp, Homo sapiens
  misc_feature: HEFZJCU01E0CFJ.13.37.D04.1.454.heavy.3.raw
tcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgttttatcactgtgcgaaagatattgtaatga

SEQ ID NO: 461631 - DNA, 403 bp, Homo sapiens; identical to SEQ ID NO: 444540
  misc_feature: HEFZJCU01AEFCI.16.72.G06.1.454.heavy.3.raw

SEQ ID NO: 461632 - DNA, 502 bp, Homo sapiens
  misc_feature: HEFZJCU01D4IJL.48.34.D01.1.454.heavy.3.raw
agtatacatacacgaccggtgctcgatttagatcgtctgtgttgggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggccgccctgctccaggagcacctccgagagcacagcggccctgggctgcctggtcaaggactacttcctatgtatact

SEQ ID NO: 461633 - DNA, 504 bp, Homo sapiens; identical to SEQ ID NO: 454912
  misc_feature: HEFZJCU01E1U0J.17.25.C03.1.454.heavy.3.raw

SEQ ID NO: 461634 - DNA, 404 bp, Homo sapiens
  misc_feature: HEFZJCU01AECT9.3.72.G06.1.454.heavy.3.raw
agacgcactccacgaccggtgctcgatttagctacgactgcaagggaaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgagaggcaggctgtgggacatagtgggtactacctatgcttttgatatctggggccaagggacaatggtcaccgtctcttcagcctccaccaagggcccatcggtcttccccctggcaccctcctccaagagcacctctgggggcacagcggccctgggctgcctggtcaagggactacttccgagtgcgtct

SEQ ID NO: 461635 - DNA, 485 bp, Homo sapiens
  misc_feature: HEFZJCU01CCZ8L.52.25.C03.1.454.heavy.3.raw
cgcagtacgacacgaccggtgctcgatttagtagtgtagatttgggtttggggtctgggagaggagcccagcactagaagtcggcggtgtttccattcggtgatcagcactgaccacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcaatagctatggcatgcactgggtccgccaggctccaggcaaggggctgaggtgggtggccagtatgtcatatggtggacttaatgcatactatgcagactccgtgaagggccgattcatcatctccagagacaattccaagaacacgctgtatctgcaaatgaacagcctgagagctgaggacacggctgtgtattactgtgcgaaagagta

SEQ ID NO: 461636 - DNA, 521 bp, Homo sapiens
  misc_feature: HEFZJCU01CEO8Y.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaaactcctactacggtctggacgtcgtggggccaggggacctaac

SEQ ID NO: 461637 - DNA, 519 bp, Homo sapiens; identical to SEQ ID NO: 453755
  misc_feature: HEFZJCU01CY2UA.9.70.G04.1.454.heavy.3.raw

SEQ ID NO: 461638 - DNA, 422 bp, Homo sapiens; identical to SEQ ID NO: 444681
  misc_feature: HEFZJCU01B30H0.16.78.H01.1.454.heavy.3.raw

SEQ ID NO: 461639 - DNA, 507 bp, Homo sapiens
  misc_feature: HEFZJCU01DJR3R.17.25.C03.1.454.heavy.3.raw
cgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataacacagcctacatggagtttgaggtagcctgaacagtctgacgacacggccgtctattactgttgcgagagtcccacgatccggtgagcctacggcagcggt

SEQ ID NO: 461640 - DNA, 506 bp, Homo sapiens
  misc_feature: HEFZJCU01AGMV0.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaacacagggactgcagtggattggatacatctacttcagtgggaaccccaactacaacccctccctcaggagtccagtcgccatatccctggactcgtccaacaaccagatctccctgacgatgacatctgtgaccgctgcggacacagccgtttattactgtgcgcgatctgggcgactcagtgactatggtatggacgtcgtggggccaagggaccacggtcatcgtctcctcagcctccaccaaggcccatcggtcttcccc

SEQ ID NO: 461641 - DNA, 504 bp, Homo sapiens
  misc_feature: HEFZJCU01CN95W.13.39.D06.1.454.heavy.3.raw
tcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctggggccaagggaccacggtcaccgtctcctcagcctccaccaaggccc

SEQ ID NO: 461642 - DNA, 491 bp, Homo sapiens
  misc_feature: HEFZJCU01C9N9R.49.85.H08.1.454.heavy.3.raw
agtcgagagacacgaccggtgctcgatttagtatcactcagtcgcgggtctcagagaggtgccttagccctggattccaaggcatttccacttggtgatcagcactgaacacagaggactcaccatggaattggggctgtgctgggttttccttgttgctattttagaaggtgtccactgtgacgtgcagctggtggagtctgggggagccttggttcagcctggagggtccctgagactctcctgtgcagcctctggattcagcttcagtagttatgagatgaactgggtccgccaggctccagggaagggactggagtgggtttcatacattagtcggagagtcaacaccgtattctacacagactctgtcaggggccgattcaccatctccagagacaacgccaagaactcactgtatctccaaatgaacagcctgagagtcgaggacacggctgtctattactgtgcgagagatcccaacagcggct

SEQ ID NO: 461643 - DNA, 481 bp, Homo sapiens; identical to SEQ ID NO: 448054
  misc_feature: HEFZJCU01BLPTZ.22.36.D03.1.454.heavy.3.raw

SEQ ID NO: 461644 - DNA, 533 bp, Homo sapiens; identical to SEQ ID NO: 446098
  misc_feature: HEFZJCU01DT489.7.78.H01.1.454.heavy.3.raw

SEQ ID NO: 461645 - DNA, 514 bp, Homo sapiens
  misc_feature: HEFZJCU01BS80Q.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaactcctactacggtctggacgtctggggccaggggacc

SEQ ID NO: 461646 - DNA, 505 bp, Homo sapiens
  misc_feature: HEFZJCU01BR7ZE.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgacttctggggccaggg

SEQ ID NO: 461647 - DNA, 481 bp, Homo sapiens
  misc_feature: HEFZJCU01EF0MZ.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcaggggtcaccatcgaccagggacacgtccatcagcacgtccatcagcacagcctacatggacctgagcggcctgacatctgacgacacggccgtatatttctgtgcgaggg

SEQ ID NO: 461648 - DNA, 512 bp, Homo sapiens
  misc_feature: HEFZJCU01C74FB.22.82.H05.1.454.heavy.3.raw
  modified_base (148)..(148): a, c, t, g, unknown or other
  modified_base (443)..(443): a, c, t, g, unknown or other
  modified_base (471)..(471): a, c, t, g, unknown or other
acatacgcgtcacgaccggtgctcgatttagtcgagctctctcgcggggtctgagagaggagcccagccctgggattttcaggtgttttcatttggtgatcaggactgaacagagagaactcaccatggagtttgggctgagcggtgngtttctaggtggctattttaaaacgtgtccagtgtgaggtgcagctggcggagtctgggggaggcctggtacagccgggggggtccctgagactctcctgtgtagcctccggattcacctttagcagacatggcatgagctgggtccgccaggctccagggaagggccggagtgggtgtcagtcattagtagtagtggtgatagaatttaccacacagactccgtgaagggccgcttcaccatctctagagacaattcccagaacacactgtatctgcaaatgaactaggctganagcgacgacacggccatttaatactgcncgaaggatatacgggtcgaccaacggtggactacgcgtttt

SEQ ID NO: 461649 - DNA, 528 bp, Homo sapiens; identical to SEQ ID NO: 448261
  misc_feature: HEFZJCU01BMK6L.18.33.C11.1.454.heavy.3.raw

SEQ ID NO: 461650 - DNA, 393 bp, Homo sapiens; identical to SEQ ID NO: 449969
  misc_feature: HEFZJCU01AXEWD.5.70.G04.1.454.heavy.3.raw

SEQ ID NO: 461651 - DNA, 528 bp, Homo sapiens
  misc_feature: HEFZJCU01C3VO1.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacgaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtcttcccctggccgccctgctccaggagcacctccgagagcacagccggccctgggcg

SEQ ID NO: 461652 - DNA, 339 bp, Homo sapiens; identical to SEQ ID NO: 444436
  misc_feature: HEFZJCU01C69R2.47.38.D05.1.454.heavy.3.raw

SEQ ID NO: 461653 - DNA, 493 bp, Homo sapiens
  misc_feature: HEFZJCU01C0V1S.14.25.C03.1.454.heavy.3.raw
  modified_base (442)..(442): a, c, t, g, unknown or other
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatcctccagagacaattccaagaacacgcagtatctgcaaatgaacagcctgagngctgaggacacggctgtgtaattctgtgggagagatggaggtcgatattgt

SEQ ID NO: 461654 - DNA, 504 bp, Homo sapiens
  misc_feature: HEFZJCU01D9NEK.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctgggccagggacg

SEQ ID NO: 461655 - DNA, 514 bp, Homo sapiens; identical to SEQ ID NO: 458969
  misc_feature: HEFZJCU01CDWF9.47.55.E11.1.454.heavy.3.raw

SEQ ID NO: 461656 - DNA, 548 bp, Homo sapiens
  misc_feature: HEFZJCU01C0A1U.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactggctcgccctgggcccgggaacccgtggtcaccgtctcctcagccctccaccgacggacctacgtccggttcccttccccgtcggccaccctccctaccaacgacg

SEQ ID NO: 461657 - DNA, 370 bp, Homo sapiens; identical to SEQ ID NO: 446460
  misc_feature: HEFZJCU01DQJRC.14.77.G11.1.454.heavy.3.raw

SEQ ID NO: 461658 - DNA, 482 bp, Homo sapiens; identical to SEQ ID NO: 449257
  misc_feature: HEFZJCU01EYT7P.10.35.D02.1.454.heavy.3.raw

SEQ ID NO: 461659 - DNA, 496 bp, Homo sapiens
  misc_feature: HEFZJCU01BS2QL.13.37.D04.1.454.heavy.3.raw
  modified_base (471)..(471): a, c, t, g, unknown or other
tcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttancactgtgcgaaagatattgtaatga

SEQ ID NO: 461660 - DNA, 497 bp, Homo sapiens
  misc_feature: HEFZJCU01A1F7Y.14.12.B01.1.454.heavy.3.raw
cgtctagtaccacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaagggccgattcgccatctccagagacaattccaggaacacgctgtacctggagatggacggcctgagacctgacgacacggcaatttattactgtgcgagggtttatgtgttggaacgtggtacaccggaaaactggttcgaccctggggccagggaaccctggtcgtcgtctcgtctgctccaccaagggcccatcggtctcccctggcgccctgctccaggagcacctccgagagcacagcggccctgggctgcctggtcaaggactacttccgtactagacg

SEQ ID NO: 461661 - DNA, 507 bp, Homo sapiens; identical to SEQ ID NO: 450163
  misc_feature: HEFZJCU01B471P.16.21.B10.1.454.heavy.3.raw

SEQ ID NO: 461662 - DNA, 525 bp, Homo sapiens
  misc_feature: HEFZJCU01D3IXO.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacgaacgttactacgcctagtgggacgtcgtggggccaaggggacccg

SEQ ID NO: 461663 - DNA, 518 bp, Homo sapiens
  misc_feature: HEFZJCU01C72A8.53.10.A10.1.454.heavy.3.raw
cgcgtatacacacgaccggtgctcgatttagcgtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgccctccagggggacctttggggtttcgacccctggggccagggaaccctggtcaccgtctcctcagcctccaccaagggcccatcggtcttcccctggcaccctcctccaagagcacctctgggggc

SEQ ID NO: 461664 - DNA, 400 bp, Homo sapiens; identical to SEQ ID NO: 444452
  misc_feature: HEFZJCU01BF3R3.47.24.C02.1.454.heavy.3.raw

SEQ ID NO: 461665 - DNA, 482 bp, Homo sapiens
  misc_feature: HEFZJCU01EAAQN.19.53.E09.1.454.heavy.3.raw
tactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatag

SEQ ID NO: 461666 - DNA, 523 bp, Homo sapiens
  misc_feature: HEFZJCU01D9ULX.12.33.C11.1.454.heavy.3.raw
atacgacgtacacgaccggtgctcgatttagagtgagctcgttgggtttggggggaagaggaagactgacggtccccccaggagttcaggtgctgggcacggtgggcatgtgtgagttttgtcacaagatttgggctcaactctcatgtgcagggtctggattcaactttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaagggctcatcggtcttcccctggccaccctcctccaagagcacctctgggggcacac

SEQ ID NO: 461667 - DNA, 503 bp, Homo sapiens
  misc_feature: HEFZJCU01DFESN.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttgggtggctaccggcggggctgaccacgtggggccg

SEQ ID NO: 461668 - DNA, 340 bp, Homo sapiens
  misc_feature: HEFZJCU01DZNNF.48.24.C02.1.454.heavy.3.raw
agtatacatacacgaccggtgctcgatttagtacagatcgttagggaaagggcagagtcacgattaccgcggacaaatccacgagcacagcctacatggagctgagcgagcctgagatctgaggacacggccgtgtattactgtgcgagagatcagagtggttattatctccgtggtactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttcctatgtatact

SEQ ID NO: 461669 - DNA, 536 bp, Homo sapiens; identical to SEQ ID NO: 458006
  misc_feature: HEFZJCU01DA309.17.28.C06.1.454.heavy.3.raw

SEQ ID NO: 461670 - DNA, 493 bp, Homo sapiens
  misc_feature: HEFZJCU01DZXH8.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagcgtggtttcgtcgttaggctctttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtct

SEQ ID NO: 461671 - DNA, 523 bp, Homo sapiens
  misc_feature: HEFZJCU01CHPCR.10.35.D02.1.454.heavy.3.raw
catagtagtgcacgaccggtgctcgatttagcacacgatagttgggtttgggggggagaggagccccagccctgggattcccaagtgtcttcattcagtgatcagtactgaacacagaggactcaccatggagtttgggctgaggtggattttccttgctgcaattttaaaaggtgtccagtgtgacgtgcagttggtggagtctgggggaggcttggttaagccgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattatgtaccactaagagtcccacgaagactgtgggaagggactgctggggcc

SEQ ID NO: 461672 - DNA, 526 bp, Homo sapiens
  misc_feature: HEFZJCU01BQDE3.43.57.F02.1.454.heavy.3.raw
tgtgagtagtcacgaccggtgctcgatttagctcgatatagttgggtttgggggaggcttgatacagccggggggtccctgagactctcctgtgtagcctctggattcacctttaacaactatgccatgacctgggtccgccaggctccagggaaggggctggagtgggtctcagtaataagtggaagtgctggtaccacactttatgcagactccgtgatgggccggttcaccatctccagagacaattccaagaacacgctgtgtctgcaaatgaacagcctgagagccgaagacacggccgtatattactgtgcgagaggcgtcggagagtacgatattttgactggttatttgcgctactactactacgctttggacgtctggggccaagggaccacggtcaccgtctcctcagcctccaccaagggcccatcggtctcccctggcgccctgctccaggagcacctcccgagagcacagcggccctgggcctgcctggtcaaggactacttccactactcac

SEQ ID NO: 461673 - DNA, 519 bp, Homo sapiens; identical to SEQ ID NO: 452709
  misc_feature: HEFZJCU01A8VMD.3.82.H05.1.454.heavy.3.raw

SEQ ID NO: 461674 - DNA, 489 bp, Homo sapiens; identical to SEQ ID NO: 448494
  misc_feature: HEFZJCU01DXG4G.16.67.G01.1.454.heavy.3.raw

SEQ ID NO: 461675 - DNA, 509 bp, Homo sapiens
  misc_feature: HEFZJCU01AYZIL.11.67.G01.1.454.heavy.3.raw
cgagagataccacgaccggtgctcgatttagagtatacatattggggggggcttggtgcagccgagggggtccctgagactctcctgtgtaggctctggattcagttttagcagctacgccatgacctgggtccgccaggctccagggaaggggctggagtgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtccagatattgcactggtggcaactgctacgacgcctactattatcaccacatggacgtctggggcaaagggaccacggtcatcgtctcctcagcctccaccaagggcccatcggtcttccccctggcaccctcctccaagagcacctctgggggcacagcgccctggctgcctggtcaaggactac

SEQ ID NO: 461676 - DNA, 515 bp, Homo sapiens; identical to SEQ ID NO: 459633
  misc_feature: HEFZJCU01DSKX1.12.55.E11.1.454.heavy.3.raw

SEQ ID NO: 461677 - DNA, 529 bp, Homo sapiens
  misc_feature: HEFZJCU01B2BHB.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttgggcagggaaccctggtcaccgtctcctcagcctccaccaaggcccatcggtcttcccctggcaccctcctccagagcacctctgggggccacagcggccctgggctgcctc

SEQ ID NO: 461678 - DNA, 514 bp, Homo sapiens
  misc_feature: HEFZJCU01DKTVZ.16.9.A09.1.454.heavy.3.raw
tgtactactccacgaccggtgctcgatttagcgagacgcgcagggggagagaggggcccagccctgggattttcaggtgttttcatttggtgatcaggactgaacagagagaactcaccatggagtctgggctgagcgtggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactgggccg

SEQ ID NO: 461679 - DNA, 505 bp, Homo sapiens
  misc_feature: HEFZJCU01CQ2R1.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggccgccaggctccagggaaggggctggagtgggtctcagttattgaaacagatggcactacatattattctgactccgtgaagggccggttcacccctctccagagacacttccaacaacatcttgtatcttcacatgcacaatctgagagtcgacgacacggccacctattattgtgcgcgacatgactacgctcaattctggggccagggacg

SEQ ID NO: 461680 - DNA, 542 bp, Homo sapiens
  misc_feature: HEFZJCU01EQDI5.16.39.D06.1.454.heavy.3.raw
tgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccagggaaggggctggaatgggtctcagttattgaaaatgatggtgacacaatctacgccgactccgtgaagggccgattcaccatctccagagacaattccaagaacacggtgaatcttcaaatgaacagcctgagaaccgaggacacggccgtatattattgtataggttatggtggtaattcgggcccctggggccagggaaccgtggtcaccgtctcctcagcctccacc

SEQ ID NO: 461681 - DNA, 528 bp, Homo sapiens
  misc_feature: HEFZJCU01CT7N9.13.55.E11.1.454.heavy.3.raw
tcacgtactacacgaccggtgctcgatttagcactcgcacgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacggcaaatatggttcaggggtagttcgacttactgggggccaggggaaccctgggtcaccgtctcctcagccctccaccaaggg

SEQ ID NO: 461682 - DNA, 505 bp, Homo sapiens
  misc_feature: HEFZJCU01DJUFO.48.2.A02.1.454.heavy.3.raw
agtatacatacacgaccggtgctcgatttagactcatctacaggggctcagagaggagccttagccctggactccaaggcctttccacttggtgatcagcactgagcacagaggactcaccatggaattggggctgagctgggttttccttgttgctattttagaaggtgtccagtgtgaggagcagctggtggagtctgggggaggcttggtccagcctggggggtccctgagactctcctgtgttgcctctgggttcacatttcgtaacaattggatgacctgggtccgccaggctccagggaaggggctggagtgggtggccaatataaaccgagatggaaataagatatactatgtggactctgttaagggccgattcaccatctccagagacaacgccaagagttcactgtttctgcaaatgagcagcctgagagccgaggacacggctctatattactgtacgagagtatttcagcccctcccaaagtggaaattatta

SEQ ID NO: 461683 - DNA, 408 bp, Homo sapiens; identical to SEQ ID NO: 446115
  misc_feature: HEFZJCU01EK8T9.51.71.G05.1.454.heavy.3.raw

SEQ ID NO: 461684 - DNA, 522 bp, Homo sapiens
  misc_feature: HEFZJCU01D0TGO.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggccagggaaccctggtgaccgtctcctcagcctccaccaagggcccatcggtcttcccctggcgccctgctccaggacgcacctccgagagcacacgcggcccc

SEQ ID NO: 461685 - DNA, 520 bp, Homo sapiens
  misc_feature: HEFZJCU01CVZRH.2.81.H04.1.454.heavy.3.raw
acgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctggtggagtccgggggaggctgggtccagcctggggggtccctgagactctcctgttcagcctctggattcacctttagtaggttttggatgagttgggtccgccaggctccagggaagggctggagtgggtggccaacatagagtacgatggaagtgagaaaaactatgtggactccgtgaagggccgattcaccatctccagagacaacgacaagaatttagtgtatctgcaaatgagcagcctgagagccgaggacacggctgtgtattattgtgcgag

SEQ ID NO: 461686 - DNA, 515 bp, Homo sapiens
  misc_feature: HEFZJCU01BOZT3.13.87.H10.1.454.heavy.3.raw
tcacgtactacacgaccggtgctcgatttagcagtactgcgttgggtttgggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaaggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgacaaagatcccaaccccttacgtacttttggtagttggttacg

SEQ ID NO: 461687 - DNA, 513 bp, Homo sapiens
  misc_feature: HEFZJCU01DZ3KZ.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcctttttacacctccttgacttctggggcc

SEQ ID NO: 461688 - DNA, 374 bp, Homo sapiens; identical to SEQ ID NO: 447434
  misc_feature: HEFZJCU01BLI3Z.13.5.A05.1.454.heavy.3.raw

SEQ ID NO: 461689 - DNA, 508 bp, Homo sapiens; identical to SEQ ID NO: 444619
  misc_feature: HEFZJCU01EOREN.3.81.H04.1.454.heavy.3.raw

SEQ ID NO: 461690 - DNA, 494 bp, Homo sapiens
  misc_feature: HEFZJCU01DXBH8.4.28.C06.1.454.heavy.3.raw
agcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgaggggccgattcaccatcttcagagacaacgccaaggacacgctgtatctggaaatgagcagtctgagagccgaggacacggctgtgtattactgtgcaagagataacggacttggtacgccctttgactactggggcccggggaccctggtcaccgtctcctcggcctccaccaagggcccatcggtcttccccctggccgccctgctccaggagcacctccgagagcacagcggccctgggctgcctggtcaaggactacttccctacagtgct

SEQ ID NO: 461691 - DNA, 529 bp, Homo sapiens
  misc_feature: HEFZJCU01EDCYI.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagcgaggacacggccatgtattactgtgtggggcatttacttgacccctggggccggggaaccctggtcaccgtctccccaccctccaaccg

SEQ ID NO: 461692 - DNA, 512 bp, Homo sapiens
  misc_feature: HEFZJCU01D5MRY.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggccgtggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagaggagctattatcgtacggaaccccgtatcgttcg

SEQ ID NO: 461693 - DNA, 523 bp, Homo sapiens
  misc_feature: HEFZJCU01BVJOQ.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccgttgttaggttattttagaaggtgtccagtgtgaggtgcacttggtggagtctgggggaggcttggtccaggccgggggggtccctgagactctcctgtgcagtctctggattcacccttagaagttattggatgacctgggtccgccaggctccagggaaggggctggagtgggtggccaacataaaacaaagacggaagtcaagaaaactatgtggactctgtgaacgggccgattcaccatctccagagacaacgccaagaattcactgtatttgcaaatgaacagcctgagaggcgaggacacggccgtgtattattgtgcgcgagatggataggtagacttctaccagtagcaggtggta

SEQ ID NO: 461694 - DNA, 506 bp, Homo sapiens
  misc_feature: HEFZJCU01DQ8HJ.10.23.C01.1.454.heavy.3.raw
catagtagtgcacgaccggtgctcgatttagtacacgtgattagggattgggggggagaggagccccagccctgagattcccaggtgtttccattcagtgatcagcactgaacacagaggactcaccatggagttgggactgagctggattttccttttggctattttaaaaggtgttcagtgtgaagtgcagctggtggagtctgggggaggcttggtacagcctggcaggtccctgagactctcctgtgcagcctctggattcagctttgatgaatatgccatggactgggtccggcaagttccagggaagggcctggagtgggtctcaggtattgattggaatagtggtaccattgcctatgcggactctgtgaagggccgattcaccatcaccagagacgacgccaggagctccctgtatctccaaatgaacagtctgagacctgaggacacggccttgtattactgtgtaagagggagtcagggtttcaactattatagtt

SEQ ID NO: 461695 - DNA, 522 bp, Homo sapiens
  misc_feature: HEFZJCU01ANWGU.12.40.D07.1.454.heavy.3.raw
atacgacgtacacgaccggtgctcgatttagtgatagagcgtaacaacagagggctcaccatggagtttgggctgagcgtgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttcccctggcg

SEQ ID NO: 461696 - DNA, 395 bp, Homo sapiens; identical to SEQ ID NO: 444494
  misc_feature: HEFZJCU01EW2MY.47.46.E02.1.454.heavy.3.raw

SEQ ID NO: 461697 - DNA, 508 bp, Homo sapiens; identical to SEQ ID NO: 445594
  misc_feature: HEFZJCU01BZHYV.17.25.C03.1.454.heavy.3.raw

SEQ ID NO: 461698 - DNA, 499 bp, Homo sapiens
  misc_feature: HEFZJCU01D7MQ4.10.71.G05.1.454.heavy.3.raw
catagtagtgcacgaccggtgctcgatttagtgtcgtcgcaagagagaggggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatcctagtggcatcacctggtattg

SEQ ID NO: 461699 - DNA, 374 bp, Homo sapiens; identical to SEQ ID NO: 444640
  misc_feature: HEFZJCU01BUK6N.7.37.D04.1.454.heavy.3.raw

SEQ ID NO: 461700 - DNA, 531 bp, Homo sapiens; identical to SEQ ID NO: 448278
  misc_feature: HEFZJCU01CKJ64.19.48.E04.1.454.heavy.3.raw

SEQ ID NO: 461701 - DNA, 497 bp, Homo sapiens
  misc_feature: HEFZJCU01BPIYA.48.34.D01.1.454.heavy.3.raw
agtatacatacacgaccggtgctcgatttagatcgtctgtgttgggtttggggggaagaggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggtgccctgctccaggagcacctccgagagcacagcggccctgggctgcctggtcaaggactacttcctatgtatact

SEQ ID NO: 461702 - DNA, 519 bp, Homo sapiens
  misc_feature: HEFZJCU01EYV42.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatgggtctcagttattcataccgacggtaccatatatgacgcagactccgtgaagggccgattcaccatctccagagaccattccaagaacaccctatatcttcaaatgaacaacctgagagtcgaagacacggccgtatattactgtgcgagacatgacttcggtgacccctgggccgagggaaccctggtcaccgtctcctcag

SEQ ID NO: 461703 - DNA, 529 bp, Homo sapiens; identical to SEQ ID NO: 446480
  misc_feature: HEFZJCU01DVUJ3.18.33.C11.1.454.heavy.3.raw

SEQ ID NO: 461704 - DNA, 534 bp, Homo sapiens
  misc_feature: HEFZJCU01D64MR.9.30.C08.1.454.heavy.3.raw
tgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgactccatcaccggtactaattactactggagttggatccgccacgccccccgggaagggccctggagtggattggatacgccttttacagtggagtcacctactacaacccgtcctcaagagccgagttaccatatctgtcgacacgtcccagaatcagttctccctggagtgacctctgtgactgccgcagactcggccgtgtatttctgtgccagaacgcaaagcagcgcctactatactttaaactttgactttctggggccagggactccctggtccaccgttcctcctcacgcctaccc

SEQ ID NO: 461705 - DNA, 489 bp, Homo sapiens
  misc_feature: HEFZJCU01CYPAM.47.85.H08.1.454.heavy.3.raw
agctcacgtacacgaccggtgctcgatttagtatcactcagtcggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgcctccaggacgcacctccgagagcacagcggccctgggctgcctggtcaaggactacttcctacgtgagct

SEQ ID NO: 461706 - DNA, 376 bp, Homo sapiens
  misc_feature: HEFZJCU01DZUZN.49.77.G11.1.454.heavy.3.raw
agtcgagagacacgaccggtgctcgatttagctagtcactcaagggaaaggggctggagtgggtggccaacataaaccaagatggaactgtggaagactacatagactctgtgaagggccgattcaccatctccagagacaacgccaagaattcactgtttctgcacatgagcagtctgagagtcgaggacacggccttctattattgtgtgagtcagagtggcccaacccattggagccagggaaccctagtcagcgtctcctcagcctccaccaagggcccatcggtcttccccctggcgccctgctccaggagcacctccgagagcacagcggccctgggctgcctggtcaaggactacttcctctctcgact

SEQ ID NO: 461707 - DNA, 532 bp, Homo sapiens
  misc_feature: HEFZJCU01CS806.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactgggccagggaaccctggtcaccgtctcctcagcctccaccaacggg

SEQ ID NO: 461708 - DNA, 500 bp, Homo sapiens
  misc_feature: HEFZJCU01CQ44E.21.19.B08.1.454.heavy.3.raw
tcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtacctatagtatgaattggatccgccaggctccaggaaaggggctggagtggctctcacagattagtggtagtagtagttttcatatattacgcagactcagtgcagggccgattcaccatctccagagacaacgccaagaattccctgtatctgcaaatggacagcctgagagtcgaggacacggctatgtattactgtgcggtgctggggcgggatgacagctggggccac

SEQ ID NO: 461709 - DNA, 507 bp, Homo sapiens
  misc_feature: HEFZJCU01CBGI9.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactccctccataaacacagcctacatggagttgaggagcctgacatctgacgacacggccgtctattactgtgcgagagtcccacgatccggtgagcctacggcaggcggccttttgactttcgt

SEQ ID NO: 461710 - DNA, 507 bp, Homo sapiens
  misc_feature: HEFZJCU01ENMM6.51.59.F04.1.454.heavy.3.raw
cgatcgtatacacgaccggtgctcgatttagtacacacacttagggattgggggctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctgggggggggctggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctggaggacgacggctatgttttactgtgcgaggagggaactcgattacagcagccc

SEQ ID NO: 461711 - DNA, 464 bp, Homo sapiens
  misc_feature: HEFZJCU01C8FKG.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgccgcacccgtgagaggcagatttaccatgtcaagagatgattcacaaagtacagtgtatctgcaaatgaacagcctgaagaccgaggacacagccatttactattgtacaaatgaatactggggacgggggaaaattggggccagggaaccctggtctccgtctcgtcagcctccaccaagggcccatcggtcttccccctggcgccctgctccaggagcacctccgagagcacagcggccctgggctgcctggtcaaggactacttcccacgagagta

SEQ ID NO: 461712 - DNA, 492 bp, Homo sapiens
  misc_feature: HEFZJCU01A3F9D.11.38.D05.1.454.heavy.3.raw
cgagagataccacgaccggtgctcgatttagtatctgatagttgggtttgggggaggcttggtacagcctggggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagcggtggtagctgctactggggccagggaaccctggtcaccgtctcctcagcctccaccaagggcccatcggtcttcccctggccaccctcctccaagagcacctctgggggcacagcggccctgggctgcctggtcaaggactacttccgtatctctcg

SEQ ID NO: 461713 - DNA, 532 bp, Homo sapiens; identical to SEQ ID NO: 445228
  misc_feature: HEFZJCU01DWV5H.7.78.H01.1.454.heavy.3.raw

SEQ ID NO: 461714 - DNA, 480 bp, Homo sapiens; identical to SEQ ID NO: 445011
  misc_feature: HEFZJCU01AX3I3.22.36.D03.1.454.heavy.3.raw

SEQ ID NO: 461715 - DNA, 394 bp, Homo sapiens
  misc_feature: HEFZJCU01C65EL.47.46.E02.1.454.heavy.3.raw
agctcacgtacacgaccggtgctcgatttagactcatctacagggaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttctacgtgagct

SEQ ID NO: 461716 - DNA, 480 bp, Homo sapiens; identical to SEQ ID NO: 445011
  misc_feature: HEFZJCU01C3W68.22.36.D03.1.454.heavy.3.raw

SEQ ID NO: 461717 - DNA, 496 bp, Homo sapiens
  misc_feature: HEFZJCU01AZYTR.51.78.H01.1.454.heavy.3.raw
cgatcgtatacacgaccggtgctcgatttagtgtgagtagtttgggtttgggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttcccctggcaccctcctccaagagcacctcgtgggggcacagcggccctgggctgcctggtcaaggactacttcctcgtagcact

SEQ ID NO: 461718 - DNA, 499 bp, Homo sapiens
  misc_feature: HEFZJCU01CM93T.40.81.H04.1.454.heavy.3.raw
tctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtcggaagagacgttggtggctaccggcggggctgaccacgtc

SEQ ID NO: 461719 - DNA, 494 bp, Homo sapiens
  misc_feature: HEFZJCU01AE78T.51.78.H01.1.454.heavy.3.raw
cgatcgtatacacgaccggtgctcgatttagtgtgagtagtttgggtttgggtatcactgaacacagaggactcaccatggagtttgggctgagcgtgggttttcctcgttgctcttttaagaggtgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggctctttttactgtgcgccaggaagcagtggctggccacatcatgtcttttgatatctggagccgaagggacaagtggtcatcgtt

SEQ ID NO: 461720 - DNA, 400 bp, Homo sapiens; identical to SEQ ID NO: 444452
  misc_feature: HEFZJCU01DR1Q2.47.24.C02.1.454.heavy.3.raw

SEQ ID NO: 461721 - DNA, 496 bp, Homo sapiens
  misc_feature: HEFZJCU01DHQUB.11.81.H04.1.454.heavy.3.raw
cgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggtggagtctgggggaggcgtggtccagcctgggaggtccctgagactctcctgtgcagcgtctggattcaccttcaggagctatgacatgcactgggtccgccaggctccaggcaaggggctggagtgggtggcagttatatggtatgatggaagttataaatactatggagactccgtgaagggccgattcaccatctccagagacacttccaagaacacggtgtatctgcaaatgaacagcctgagagccgaggaccacggct

SEQ ID NO: 461722 - DNA, 480 bp, Homo sapiens
  misc_feature: HEFZJCU01DRODH.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctgtcaccgtctcctcagcctccaccaagggcccatcggtcttcccctggcaccctcctccaagagcacctctgggggcacagcgccctgggctgcctggtcaaggactacttcctagagacacg

SEQ ID NO: 461723 - DNA, 469 bp, Homo sapiens; identical to SEQ ID NO: 454497
  misc_feature: HEFZJCU01C87SY.48.56.F01.1.454.heavy.3.raw

SEQ ID NO: 461724 - DNA, 500 bp, Homo sapiens
  misc_feature: HEFZJCU01C03HF.48.59.F04.1.454.heavy.3.raw
agtatacatacacgaccggtgctcgatttagtacacacacttagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctccaaaagtcgaaggcaccatatccgtagacacgtccaagaaccaattctccctgaagctgagctctgtgaccgccgcagacacggctgtctattactgtgcggtaggccccgagcgcagtggctttttgattgccttgatatgtgggccaagggacaat

SEQ ID NO: 461725 - DNA, 503 bp, Homo sapiens
  misc_feature: HEFZJCU01BKHLP.3.23.C01.1.454.heavy.3.raw
agacgcactccacgaccggtgctcgatttagtacacgtgatcaggactgaacacagaggactcaccatggactttgggctgaggtggattttccttgctgccattttaaaaggtttcccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaagtaagactgctggtgagacaacagactacgctgctgccttcagaggcagattcaccatcttcagagatgaatcacagagcactctgtttctgcaaatgaacagcctggaagacgcggacacagccatgtattattgtacattaggacactatagtccctggggccagggaaccctcgtcaccgtctcctcagcctccaccaagggcccatcggtccttccccc

SEQ ID NO: 461726 - DNA, 482 bp, Homo sapiens
  misc_feature: HEFZJCU01BBFLQ.19.67.G01.1.454.heavy.3.raw
tactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggaggggccgattcaccatctccagagactttttctcagaacacactgtctcttcaaatgaacagcctgagggccgaggacacggccgtctattattgtgtgagagtttatggcgatggctggtggacagatcactggggccagggaaccctggtcaccgtctcctcagcctccaccaagggcccatcggtcttcccctggcgccctgctccaggagcacctccgagagcacagcggccctgggctgcctggtcaaggactacttcccacgagagta

SEQ ID NO: 461727 - DNA, 501 bp, Homo sapiens; identical to SEQ ID NO: 457262
  misc_feature: HEFZJCU01EHIGP.12.38.D05.1.454.heavy.3.raw

SEQ ID NO: 461728 - DNA, 535 bp, Homo sapiens
  misc_feature: HEFZJCU01C3F4T.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactgggccgagggaaccctggtcaccgtctcctcagcctccaccaagggccc

SEQ ID NO: 461729 - DNA, 501 bp, Homo sapiens; identical to SEQ ID NO: 447719
  misc_feature: HEFZJCU01CUV4M.17.10.A10.1.454.heavy.3.raw

SEQ ID NO: 461730 - DNA, 395 bp, Homo sapiens; identical to SEQ ID NO: 445227
  misc_feature: HEFZJCU01BTIJA.47.46.E02.1.454.heavy.3.raw

SEQ ID NO: 461731 - DNA, 512 bp, Homo sapiens
  misc_feature: HEFZJCU01EB2NN.9.14.B03.1.454.heavy.3.raw
tgatacgtctcacgaccggtgctcgatttagtgtgagtagtttgggtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccaggggaaccctggtcaccgtctcctcagcctccaccaagggcccatccggtcttcccctggcgccctgctccaggagcacctccgacgagcacagcggccctgggctgcctggtcaaggactacttccagacgtatca

SEQ ID NO: 461732 - DNA, 332 bp, Homo sapiens; identical to SEQ ID NO: 446898
  misc_feature: HEFZJCU01E2QD7.12.71.G05.1.454.heavy.3.raw

SEQ ID NO: 461733 - DNA, 515 bp, Homo sapiens
  misc_feature: HEFZJCU01A4OKV.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaacctcctccataaacacagcctacatggagttgagggacgcctgacatctgacgacacggccgtctattactgtgcgagacgtcccacgatccggtgacgcctacggcaggcggccttttggacctttcgtac

SEQ ID NO: 461734 - DNA, 403 bp, Homo sapiens; identical to SEQ ID NO: 444658
  misc_feature: HEFZJCU01BFOWU.14.60.F05.1.454.heavy.3.raw

SEQ ID NO: 461735 - DNA, 487 bp, Homo sapiens
  misc_feature: HEFZJCU01DRU5N.52.6.A06.1.454.heavy.3.raw
cgcagtacgacacgaccggtgctcgatttagatctactgacaggggtctgggagacgagcccagcactggaagtcgccggtgtttccattcggtgatcatcactgaacacagaggactcaccatggagtttgggcagagctgggttctcctcgttgttcttttaagaggtgtcctgtgcaggctctgcatttcccttcagtaactatgctatcgattgggtccgccaggctccaggcaagggactggagtgggtggcagttatatcagctgatggaggcaataagtattacgcagattctgcgaggggccgattcaccatatccagagacaactcccaagatatgatatatctgcaaatgaacagcctgagacctgaggacacggccatatattattgtgcgtcagggggcagtgcctggccacgtgatgctttgatttctggggccaagggacattcgtcaccgtctcctcagcctccaccaaggg

SEQ ID NO: 461736 - DNA, 400 bp, Homo sapiens; identical to SEQ ID NO: 444452
  misc_feature: HEFZJCU01AHLUO.47.24.C02.1.454.heavy.3.raw

SEQ ID NO: 461737 - DNA, 525 bp, Homo sapiens
  misc_feature: HEFZJCU01AZPJY.4.66.F11.1.454.heavy.3.raw
agcactgtagcacgaccggtgctcgatttagtcacgcgagaagggggggagaggagccccagccttgggattcccaagtgttttcattcagtgatcaggactgaacacagaggactcaccatggagtttgggctgagctggattttccttactgctattttaaaaggtgtccagtgtgaggtgaaactggtggagtctgggggaggcttgataaagcctggggggtcccttagactctcctgtgcagcctctggattcaccttcagtgacgactggatgaattggatccgccaggctccagggaaggggctggagtgggtcggccatattaagcccaaaactgaacgtggggaaacagactacgctgcacccgtgagaggcagattcaccatttcaagagatgattcaaaaagtacactgtatctggaatgaacagcctgagaatcgacgacacagccgtttattactgcagaagagggcactatggtccctggggccagggaaccctggtcaccgtctcctcag

SEQ ID NO: 461738 - DNA, 512 bp, Homo sapiens; identical to SEQ ID NO: 445688
  misc_feature: HEFZJCU01CALE3.3.34.D01.1.454.heavy.3.raw

SEQ ID NO: 461739 - DNA, 494 bp, Homo sapiens
  misc_feature: HEFZJCU01EB2AD.48.73.G07.1.454.heavy.3.raw
agtatacatacacgaccggtgctcgatttagctctacgctcaggggatgctttctgagagtcatggatctcatgtgcaagaaaatgaagcacctgtggttcttcctcctgctggtggcggctcccagatgggtcctgtcccagctgcagctgcaggagttgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtggggccgaagggacaatggtc

SEQ ID NO: 461740 - DNA, 503 bp, Homo sapiens
  misc_feature: HEFZJCU01AUQ2E.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatgggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccggcggggctgaccacgtggggccg

SEQ ID NO: 461741 - DNA, 508 bp, Homo sapiens
  misc_feature: HEFZJCU01CZBD6.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttgggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactgggg

SEQ ID NO: 461742 - DNA, 379 bp, Homo sapiens; identical to SEQ ID NO: 444549
  misc_feature: HEFZJCU01B6GDD.47.77.G11.1.454.heavy.3.raw

SEQ ID NO: 461743 - DNA, 481 bp, Homo sapiens; identical to SEQ ID NO: 445517
  misc_feature: HEFZJCU01AX12S.22.36.D03.1.454.heavy.3.raw

SEQ ID NO: 461744 - DNA, 494 bp, Homo sapiens
  misc_feature: HEFZJCU01BNT6F.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccaagagcacctctgggggcacagcggccctggctgcctggtcaaggactacttccgagtagtaa

SEQ ID NO: 461745 - DNA, 515 bp, Homo sapiens; identical to SEQ ID NO: 445422
  misc_feature: HEFZJCU01B9C48.4.57.F02.1.454.heavy.3.raw

SEQ ID NO: 461746 - DNA, 506 bp, Homo sapiens; identical to SEQ ID NO: 456818
  misc_feature: HEFZJCU01B9PIU.51.65.F10.1.454.heavy.3.raw

SEQ ID NO: 461747 - DNA, 532 bp, Homo sapiens
  misc_feature: HEFZJCU01EOUS8.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgaagagccgaggacacggccatgtattactgtgtggggcatttacttgacccgtggggccggggaacccgtggtcaccgtctccccaccctccaaccg

SEQ ID NO: 461748 - DNA, 512 bp, Homo sapiens
  misc_feature: HEFZJCU01EKGCP.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatgaacagcctgaagaccgaggacacagccgtctattactgtgttagggtagttttacgtagtttttggt

SEQ ID NO: 461749 - DNA, 329 bp, Homo sapiens
  misc_feature: HEFZJCU01EK4LO.10.42.D09.1.454.heavy.3.raw
catagtagtgcacgaccggtgctcgatttagacacatacgcagggaagggccggttcaccatctcgagagacaacaccaagaacacgctgaatctgcaaatgaacagcctgagagccgaggacacggctgtatattactgtgtgagggatgtccccccagaaagggctggttacatgtttgactcctggggccagggaatcctggtcaccgtctcctcagcctccaccaagggcccatcggtcttccccctggcgccctgctccaggagcacctccgagagcacagcggccctgggctgcctggtcaaggactacttcccactactatg

SEQ ID NO: 461750 - DNA, 531 bp, Homo sapiens
  misc_feature: HEFZJCU01BWB6U.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggcccttcacagggcggtttgtcttctccatggatacctctgtcgggacggcttatctgcagataaccaaccttcaacctgacgacactgcgtttattttgtacgagagcgtcgtctgtcagtggaattgactactggggccagggaaccctggtcaccgtctcctcagcctccaccaaggg

SEQ ID NO: 461751 - DNA, 524 bp, Homo sapiens
  misc_feature: HEFZJCU01BKKCL.51.86.H09.1.454.heavy.3.raw
cgatcgtatacacgaccggtgctcgatttagtgctatagacttgggtttgggcagggtttggggggaagaggaagactgacggtcctcccaggagttcaggtgctgggcaccgtgggcatgggggaggcgtggtccagcctgggaggtccctgagactctcctgtgcagcctctggattcaccttcaatacttatggcatgcactgggtccgccaggctccaggcaaggggctggagtggctgtcctttatctcatatgatggaggcaataaaaattatgcagactccgtgaagggccgattcaccatctccagagacaattccaagaacactctatatttgcagatgaatagcctgagaattgaggacacggctgtgtattactgtgtgagagggtcggcatattccggtttttggtagttaattatctactgggtaacttttgatatctggggccgacgggactaatggtcaccgtctcttcagcttccaccaacgggcccagtcggtccttcccctggccg

SEQ ID NO: 461752 - DNA, 530 bp, Homo sapiens
  misc_feature: HEFZJCU01EQJNB.14.35.D02.1.454.heavy.3.raw
cgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggccacagcctacatggagttgagcggcctgagatttgacgacacggccttctattactgtgcgagagaactcgctacgataaatatgcccttgcctcttgactactggggccagggaaccctggtcaccgtctcctcagcctccaccaagggcccatcggtcttccccctggcaccctcctccaagagcacctctgggggcacagcggccctggggctgcctggtcaaggactacttccg

SEQ ID NO: 461753 - DNA, 510 bp, Homo sapiens
  misc_feature: HEFZJCU01DBL8M.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccatatattactgtgcgaagcttagcggttaccggctacgattggggagcgactggttcgacccctgggaccagggaaccctggtcaccgtctcctcagcctccaccaagggcccatcggtcttcccctggccaccctcctccaagagcacctctgggggcacagcggccctgggctgcctggtcaggactacttccctacgtcgtat

SEQ ID NO: 461754 - DNA, 527 bp, Homo sapiens; identical to SEQ ID NO: 456786
  misc_feature: HEFZJCU01BOUTT.14.35.D02.1.454.heavy.3.raw

SEQ ID NO: 461755 - DNA, 324 bp, Homo sapiens; identical to SEQ ID NO: 444475
  misc_feature: HEFZJCU01DTPN6.18.17.B06.1.454.heavy.3.raw

SEQ ID NO: 461756 - DNA, 508 bp, Homo sapiens; identical to SEQ ID NO: 445594
  misc_feature: HEFZJCU01A8D6U.17.25.C03.1.454.heavy.3.raw

SEQ ID NO: 461757 - DNA, 400 bp, Homo sapiens; identical to SEQ ID NO: 444452
  misc_feature: HEFZJCU01CZ4UO.47.24.C02.1.454.heavy.3.raw

SEQ ID NO: 461758 - DNA, 498 bp, Homo sapiens
  misc_feature: HEFZJCU01A2EJ6.4.21.B10.1.454.heavy.3.raw
agcactgtagcacgaccggtgctcgatttagtgtcgtcgcaagagagggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaagggcccatcggtcttccccctggccgccctgctccaggacgcacctccgagagcacagcggccctgggctgcctggtcaaggactacttccctacagtgct

SEQ ID NO: 461759 - DNA, 406 bp, Homo sapiens
  misc_feature: HEFZJCU01EEDP1.11.70.G04.1.454.heavy.3.raw
cgagagataccacgaccggtgctcgatttagtgtagtgtgaagggaaaggggttgtaattggtgtttccagtgatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaaagtaattgttagggacctccactacggtatggacgtctggggccaagggaccacggtcaccgtctcctcagcctccaccaagggcccatcggtcttccccctggcaccctcctccaagagcacctctggggcacagcggccctgggctgcctggtcaaggactacttccgtatctctcg

SEQ ID NO: 461760 - DNA, 534 bp, Homo sapiens
  misc_feature: HEFZJCU01B88RV.16.87.H10.1.454.heavy.3.raw
tgtactactccacgaccggtgctcgatttagcagtactgcgttgggtttgggggagccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctacacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtggaaactagttatggttggggggagttgggtttttttttcgtacttagggtacg

SEQ ID NO: 461761 - DNA, 487 bp, Homo sapiens
  misc_feature: HEFZJCU01DJP4J.49.75.G09.1.454.heavy.3.raw
  modified_base (441)..(441): a, c, t, g, unknown or other
agtcgagagacacgaccggtgctcgatttagtatagacatcagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgcttcatcatctccagagacaactccgagaacacgctgtatctgcaaatgaacaggctgagagttnaagacacggctgtatattactgtgcgaacttatcacggaggacaac

SEQ ID NO: 461762 - DNA, 532 bp, Homo sapiens
  misc_feature: HEFZJCU01AYNE3.40.70.G04.1.454.heavy.3.raw
tctagcgactcacgaccggtgctcgatttagtgtagtgtgaagggaaagggggctttctgagagtcatggatctcatgtgcaagaaaatgaagcacctgtggtccttcctcctgctggtggcggctcccagatgggtcctgtcccagctgcagctgcaggagtcgggcccaggactggtgaagccttcggagaccctgtccctcacctgcactgtctctggtgcctccatcagcagtactagttactactggggctggatccgccagtccccagggaagggactggagtggattgcggctatttcttatagtgagaacacctactacaacccgtccctcaagagtcgagtcaccatatccgtagacacgtccaacaaccagttctccctgaacctgagccctgtgaccgtcgcagacacggctgtatattattgtgggagacgctttcgtgacttaggccctgactacggtcggccccataccgaggacgatttcctcggttatgggacgtcgtgggggccaaggggacccg

SEQ ID NO: 461763 - DNA, 534 bp, Homo sapiens
  misc_feature: HEFZJCU01C8I2L.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtatactgtgtggggcatttacttgaccctggggccggggaacccgtcggtcaccgtcctccccacccctcccaacccg

SEQ ID NO: 461764 - DNA, 532 bp, Homo sapiens
  misc_feature: HEFZJCU01CQT0N.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaacgggcccatccggtccttccccgtggccgccctcg

SEQ ID NO: 461765 - DNA, 484 bp, Homo sapiens
  misc_feature: HEFZJCU01B5DSZ.40.81.H04.1.454.heavy.3.raw
tctagcgactcacgaccggtgctcgatttagtagtgtagattcgcgggggcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgactctgacgacacggccatgtattactgtgaagagacgtggtggctacgcgggctgacca

SEQ ID NO: 461766 - DNA, 511 bp, Homo sapiens
  misc_feature: HEFZJCU01CIOGV.19.13.B02.1.454.heavy.3.raw
tactctcgtgcacgaccggtgctcgatttagtctagcgactttgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctgggggacacggctgtgtattactgtgcgagagcggctggcaactacatccattacggtttggacgtctggggccaagggaccacggtcatcgtctccccagcctccaccaagggcccatcggtcttcccctggcgccctgctccaggagcacctccgagagcacac

SEQ ID NO: 461767 - DNA, 525 bp, Homo sapiens; identical to SEQ ID NO: 450208
  misc_feature: HEFZJCU01DYF2I.3.82.H05.1.454.heavy.3.raw

SEQ ID NO: 461768 - DNA, 492 bp, Homo sapiens
  misc_feature: HEFZJCU01EBSIG.51.52.E08.1.454.heavy.3.raw
cgatcgtatacacgaccggtgctcgatttagtcgagctctcagagagaaagggggcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagcctggggcctcagtgaaggtctcctgcaagacttctggatacaccttcaccgactactatatgcactgggtgcgacaggcccctggacaagggcttgagtggatgggatgaatcgaccctaagaatggtgccacaaactatgcacagacttttcagggcctggggtcaccatgaccagcgacacatctagcaacacagtctacatggagttgaccagcctgacccgacacggccgtgtatttttgtgtgagagattttcggactaatccagacgacccctgt

SEQ ID NO: 461769 - DNA, 503 bp, Homo sapiens
  misc_feature: HEFZJCU01AX00L.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgacttcgt

SEQ ID NO: 461770 - DNA, 517 bp, Homo sapiens
  misc_feature: HEFZJCU01BVTEV.19.67.G01.1.454.heavy.3.raw
tactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaacctctggggtctccgtcagcagcgactgtattgcctgggtccgccaggctccagggaagaggccggagtgggtcgcaggtatttttatagggtgggacgacattctacggagactccatggagggccgattcaccatctccagagacttttctcagaacacactgtctcttcaaattgaacagcctgagggccgaggacacggccgtctattattgtgtgagagttttatggcgatggctgggttgggacaggatcgacgtc

SEQ ID NO: 461771 - DNA, 400 bp, Homo sapiens; identical to SEQ ID NO: 444452
  misc_feature: HEFZJCU01EZWYU.47.24.C02.1.454.heavy.3.raw

SEQ ID NO: 461772 - DNA, 489 bp, Homo sapiens; identical to SEQ ID NO: 452468
  misc_feature: HEFZJCU01EBX1N.16.67.G01.1.454.heavy.3.raw

SEQ ID NO: 461773 - DNA, 490 bp, Homo sapiens
  misc_feature: HEFZJCU01CMOEV.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgcaaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctggtcaggactacttccgtatctctcg

SEQ ID NO: 461774 - DNA, 383 bp, Homo sapiens
  misc_feature: HEFZJCU01DAG1T.47.29.C07.1.454.heavy.3.raw
agctcacgtacacgaccggtgctcgatttagagtgctacgaagggaaagggactggagtggattggctatctgtattacggtgggagttcaaacttcaacccctccctcaagagtcgagtcaccatttcaggagacacgtccaagaatcaggtctccttgaacctgaggcagacgaccccagcggacacggccgtctattattgtgcgagaggtcttcttgatgacgatgccctggacgactggggccagggagtccttgtcaccgtctcctcagcctccaccaagggcccatcggtcttccccctggcaccctcctccaagagcacctctgggggcacagcggccctgggctgcctggtcaaggactacttcctacggagct

SEQ ID NO: 461775 - DNA, 397 bp, Homo sapiens
  misc_feature: HEFZJCU01ALTPT.51.77.G11.1.454.heavy.3.raw
cgatcgtatacacgaccggtgctcgatttagctagtcactcaagggaaaggggctggagtggatcggagaaatccaccatagtggaaacaccaactacagcccgtccctcaagagtcgaatcaccttatcagtagacacggccaagaaccagttctccctgaggctgacttctgttaccgccgcggacacggctgtttattactgtgcgagagctttgccaagttcgtctcgttttgacccatactttgactcctggggccaaggaacgctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 461776 - DNA, 493 bp, Homo sapiens; identical to SEQ ID NO: 446939
  misc_feature: HEFZJCU01B9QJV.4.21.B10.1.454.heavy.3.raw

SEQ ID NO: 461777 - DNA, 492 bp, Homo sapiens
  misc_feature: HEFZJCU01AMJ9B.11.13.B02.1.454.heavy.3.raw
cgagagataccacgaccggtgctcgatttagtctagcgactttgggtctgggggaggcttggtccagcctggggggtccccgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctcggcgccctgctccaggagcacctccgagagcacagcggccctgggctgcctggtcaaggactacttccgtatctctcg

SEQ ID NO: 461778 - DNA, 517 bp, Homo sapiens
  misc_feature: HEFZJCU01BBCYG.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctgggccagggaaccctggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 461779 - DNA, 512 bp, Homo sapiens
  misc_feature: HEFZJCU01DOUIK.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagcgtggcgttttcttaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatataattactgtgcgaaagcaccggcaagttgcacccatactactttgactactgggccg

SEQ ID NO: 461780 - DNA, 515 bp, Homo sapiens
  misc_feature: HEFZJCU01CUE33.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaaggaggggggaaccagcgggagttccaagtactctttg

SEQ ID NO: 461781 - DNA, 517 bp, Homo sapiens
  misc_feature: HEFZJCU01EULO8.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccacagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggccctgggctgcctggtcaaggacacttccagacgtatca

SEQ ID NO: 461782 - DNA, 514 bp, Homo sapiens
  misc_feature: HEFZJCU01CFNJF.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagaccctcgatagcagtggctggtccactaggtttgactactggggccagggaagcttggtcaccgtctcctca

SEQ ID NO: 461783 - DNA, 496 bp, Homo sapiens
  misc_feature: HEFZJCU01DKUMN.52.37.D04.1.454.heavy.3.raw
cgcagtacgacacgaccggtgctcgatttagtagcatactgttgggtttgggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagtctgacatccgaggacacggccgtgtattactgtgcgagagttctttgggatgttgtcgttgcaccagctgccctacccggctgctacttcgatctctggggccgtggcaccctggtcactgtcttctcagcctccaccaaggcccatcggtcttcccctggcaccctcctccaagagcacctctgggggcacagcggccctgggctgcctggtcaaggactacttcctatacgatcg

SEQ ID NO: 461784 - DNA, 501 bp, Homo sapiens
  misc_feature: HEFZJCU01EMQ7C.48.71.G05.1.454.heavy.3.raw
agtatacatacacgaccggtgctcgatttagtgtcgtcgcaagagagaggggacaaccacattcctcctctaaagaagtccctgggagcacagctcttcaccatggactggacctggaggttcctctttgtggtggcagcagcaacaggtgtccagtcccaggtgcggctggaacaatctggggccgaagtgaggaagcctgggtcctcagtgaagatctcctgcctggcctctggaggcaccttcaatcactatgctttcaactgggtgcgacaggtccctggacaaggacttgtgtggatggggggattcatccctatgtttaagagaatcaggcgtgctgagaagttcgaggacagagtcacctttatggcggacgaatcctcgagcacagtctatatggatctggccagcctgaagtctgaagacacgggcatatatttctgtgcgacagatggtcgtggattctcgtctgcttatggaggggaagacgtggttccg

SEQ ID NO: 461785 - DNA, 520 bp, Homo sapiens
  misc_feature: HEFZJCU01DZBJ8.18.78.H01.1.454.heavy.3.raw
tacgagtatgcacgaccggtgctcgatttagtgtgagtagtttgggtttggggctgggagaggagctccagccttgggattcccagctgtctccactcggtgatcggcactgaatacaggagactcaccatggagtttgggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctggggccgggaaccgtggtcaccgtctcccca

SEQ ID NO: 461786 - DNA, 500 bp, Homo sapiens
  misc_feature: HEFZJCU01CRZ70.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtgctacgagtactggtacttcgatctctgggccgtggcaccctgctgactgtctcctcagcctccaccaagggcccatcggtcttcccctggcgccctgctccaggagcacctccgagagcacagccggcccgtgggctgccgtggtcaaggacttaccg

SEQ ID NO: 461787 - DNA, 511 bp, Homo sapiens
  misc_feature: HEFZJCU01B26FC.48.20.B09.1.454.heavy.3.raw
agtatacatacacgaccggtgctcgatttagtgtagtgtgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagccggcccgtgggctcgccgtggtcgaaggactacttcctatgtatact

SEQ ID NO: 461788 - DNA, 373 bp, Homo sapiens; identical to SEQ ID NO: 445918
  misc_feature: HEFZJCU01AFUFZ.49.30.C08.1.454.heavy.3.raw

SEQ ID NO: 461789 - DNA, 501 bp, Homo sapiens
  misc_feature: HEFZJCU01EZ3DW.49.30.C08.1.454.heavy.3.raw
agtcgagagacacgaccggtgctcgatttagtctgacgtcaaagggaaaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcttctggtggactctgggggaggcgtggtccggcctgggaggtccctgagactctcctgtgcagcctctcagttcaccttcagtgtctatactatgcactgggtccgccaggcctccaggcaaggggctggagtgggtggcacttatatacaaatgatggaagaattcaacactacgcaggctccgtgaacgggccgattcacatctccagagacaattccaagaacacactgtctctgacaatgaatagcctgagagttgaggacacggctgtctattactgtgcgagagcgtaagggacttactcat

SEQ ID NO: 461790 - DNA, 507 bp, Homo sapiens; identical to SEQ ID NO: 455143
  misc_feature: HEFZJCU01BGY6W.10.88.H11.1.454.heavy.3.raw

SEQ ID NO: 461791 - DNA, 497 bp, Homo sapiens
  misc_feature: HEFZJCU01CAF8P.48.55.E11.1.454.heavy.3.raw
agtatacatacacgaccggtgctcgatttagcactcgcacgttgggtttggggaggtctcagagaggagccttagccctggactccaaggcctttccacttggtgatcagcactgagcacagaggactcaccatggaattggggctgagctgggttttccttgttgctattttagaaggtgtccagtgtgaagtgcagctggtggagtctgggggaggcttggtccagcctggggggtccctaagactctcctgtgcagcctctggattcacctttagtacctattggatgacctgggtccgccaatctccagggggggggctggagtgggtggccaatataaagggagatggaagtgtgacacactatgtggactctgtgaagggccgattcaccatctccagagacaatgccaaggagtcactgtatctgcagatgaacagcctgagagccgaggacgcggctgtgtattactgtgcgtagagatgcgaatccct

SEQ ID NO: 461792 - DNA, 384 bp, Homo sapiens; identical to SEQ ID NO: 444454
  misc_feature: HEFZJCU01C585R.11.61.F06.1.454.heavy.3.raw

SEQ ID NO: 461793 - DNA, 510 bp, Homo sapiens
  misc_feature: HEFZJCU01CS0NY.48.86.H09.1.454.heavy.3.raw
agtatacatacacgaccggtgctcgatttagtgctatagacttgggtttggggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaaggggacaatggtcaccgtctcttcagcctccaccaaggg

SEQ ID NO: 461794 - DNA, 522 bp, Homo sapiens; identical to SEQ ID NO: 448016
  misc_feature: HEFZJCU01C6MJI.12.40.D07.1.454.heavy.3.raw

SEQ ID NO: 461795 - DNA, 522 bp, Homo sapiens
  misc_feature: HEFZJCU01D9KHY.4.33.C11.1.454.heavy.3.raw
agcactgtagcacgaccggtgctcgatttagagtgagctcgttgggtttgggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaagggctggagtgggtaggtttcattagagccatggcttatgctgggacaacagaatacgccgcgtctgtagaaaggcagattcatcatctcaagagatgattccaacggcatcgcctatctgcagatgaacagcctagaagaccgaggacacagccgtctattactgtgttagggtagttttacgtagtttttggagttggatattactaaccccctacg

SEQ ID NO: 461796 - DNA, 487 bp, Homo sapiens
  misc_feature: HEFZJCU01CIKEH.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggcaccctcctccaagagcacctctgggggcacagcggccctgggctgcctggtcaggactctcgagtgcgtct

SEQ ID NO: 461797 - DNA, 536 bp, Homo sapiens
  misc_feature: HEFZJCU01CXXJ7.22.38.D05.1.454.heavy.3.raw
acatacgcgtcacgaccggtgctcgatttagtatctgatagttgggtttggggagtgactcctgtgccccaccatggacacactttgctccacgctcctgctgctgaaaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaaccaggtggtccttacaatgaccaccatggaccctgtggacacagccacatatttctgtgcacactctataggagcacctggtagtctgccaaactggttcgacccctggggcccgggaaccctggtcaccgtctcctcagcctccaccaagggcccatcggtcttcccctc

SEQ ID NO: 461798 - DNA, 405 bp, Homo sapiens
  misc_feature: HEFZJCU01BYWXF.3.29.C07.1.454.heavy.3.raw
agacgcactccacgaccggtgctcgatttagagtgctacgaagggaaaggggctggagtgggtctcaagtattagtgataggggcgatacattttatgctggctccgtgagggggcggttcaccatctccagagacaactccaagagcaccgtgtatctgcagatgcacagcctgagagccgaggacacggccacctattactgtgcgaaacgtgtaggtcggtctacctactgttattacagtgagtgctactttgactcctggggccagggatccctggtcgccgtctcctcagcctccaccaagggcccatcggtcttccccctggcaccctcctccaagagcacctctgggggcacagcggccctgggctgcctggtcaaggactacttccgagtgcgtct

SEQ ID NO: 461799 - DNA, 494 bp, Homo sapiens
  misc_feature: HEFZJCU01DJLLU.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgatttatatcacatgatggaactaatagacgctatgccgactccgtgaagggccgattcaccatctccagagacaaattccaagaacacgcagtatctgcaaatgaacagcctgagagctgaggacacggctgtgtattactgtgggagagatggaggtcgatattgt

SEQ ID NO: 461800 - DNA, 531 bp, Homo sapiens
  misc_feature: HEFZJCU01EM6SH.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttggggccagggaaccctggtcaccgtctcctcagcctccaccaagggcccatcggtcttcccctggcaccctcctccaagagcacctctggggcacagcggccctgggctgcctc

SEQ ID NO: 461801 - DNA, 517 bp, Homo sapiens
  misc_feature: HEFZJCU01DOVG7.51.26.C04.1.454.heavy.3.raw
cgatcgtatacacgaccggtgctcgatttagtctagcgactttgggtttgggggctctgggagacgagcccagcactggaagtcgccggtgtttccattcggtgatcatcactgaacacagacatggagtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattcccgggaacacactgtctctgcaaatgaacagcctgagagctggaggacagggctgtttattactgtgtgcgatccgactcactgggtacgggagttacttcctccgcaacggt

SEQ ID NO: 461802 - DNA, 517 bp, Homo sapiens
  misc_feature: HEFZJCU01EDI9K.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctactcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggccatcggtcttcccctggcaccctcctccaagagcacctctgggggcacagcggccctgggctgcctggtcaaggactacttccagacgtatca

SEQ ID NO: 461803 - DNA, 492 bp, Homo sapiens
  misc_feature: HEFZJCU01CZF3V.19.53.E09.1.454.heavy.3.raw
tactctcgtgcacgaccggtgctcgatttagagagagtgtgttgggtttggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaaatgaaacagtctgagagctgaggacacggccttgtattactgtgcaaggaggtatagcagctactggtacgactactggggccagggaaccctggtcaccgtctcctcagcctccaccaagggcccatcggtcttcccctggcgcctgctccaggagcacctccgagacgcacagcggccctgggctgcctggtcaaggactacttcccacgagagta

SEQ ID NO: 461804 - DNA, 387 bp, Homo sapiens
  misc_feature: HEFZJCU01AG9F9.47.60.F05.1.454.heavy.3.raw
agctcacgtacacgaccggtgctcgatttagtacgtcatcagggaaagggactggagtggattggctatctgtattacggtgggagttcaaacttcaacccctccctcaagagtcgagtcaccatttcaggagacacgtccaagaatcaggtctccttgaacctgaggcagacgaccccagcggacacggccgtctattattgtgcgagaggtcttcttgatgacgatgccctggacgactggggccagggagtccttgtcaccgtctcctcagcctccaccaagggcccatcggtcttccccctggcaccctcctccaagagcacctctgggggcacagcggccctggtcaaggtgcctggtcaaggactacttcctacgtgagct

SEQ ID NO: 461805 - DNA, 497 bp, Homo sapiens
  misc_feature: HEFZJCU01ED8KZ.48.23.C01.1.454.heavy.3.raw
agtatacatacacgaccggtgctcgatttagtacacgtgattagggattggggatgctttctgagagtcatggatctcatgtgcaagaaaatgaagcacctgtggttcttcctcctgcctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtgggccaagggacaat

SEQ ID NO: 461806 - DNA, 513 bp, Homo sapiens
  misc_feature: HEFZJCU01D8CY5.4.57.F02.1.454.heavy.3.raw
agcactgtagcacgaccggtgctcgattagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtgggccagggaacccctggtcaccgtctcctcagcttccaccaagggcccatcggtcttcccctgcgccctgctccaggagcacctctgggggcacagcggcccg

SEQ ID NO: 461807 - DNA, 514 bp, Homo sapiens
  misc_feature: HEFZJCU01A9968.40.34.D01.1.454.heavy.3.raw
tctagcgactcacgaccggtgctcgatttagatcgtctgtgttgggtttgggggagtctccctcactgcccagctgggatctcagggcttcattttctgtcctccaccatcatgggggcaaccgccatcctcgccctcctcctggctgttgtccaaggagtctgtgccgaggtgcagctggtgcagtctggagcagaggtgaaaagcccggggagtctctgaagatctcctgtaagggttttggatacaactttaccatctactggatcgcctgggtgcgccagatgcccgggaaaggcctagagtgggtgggaatcgtctatcctgacgactctgataccagatacagcccgtccttccaaggccaggtcaccatctcagccgacaagtccgtcaataccgcctacctgcagtggagcagtctgcaggcctcggacaccgccatgtacttctgtgcgagagggttcggggatgactactggggccagggaaccctggtcaccgtctcttcagt

SEQ ID NO: 461808 - DNA, 518 bp, Homo sapiens; identical to SEQ ID NO: 444718
  misc_feature: HEFZJCU01D0THT.9.34.D01.1.454.heavy.3.raw

SEQ ID NO: 461809 - DNA, 496 bp, Homo sapiens
  misc_feature: HEFZJCU01DRP1Y.4.21.B10.1.454.heavy.3.raw
agcactgtagcacgaccggtgctcgatttagtgtcgtcgcaagagagggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaagggcccatcggtcttcccctcggcgccctgctccaggagcacctccgagagcacagcggccctgggctgcctggtcaaggactacttccctacagtgct

SEQ ID NO: 461810 - DNA, 400 bp, Homo sapiens; identical to SEQ ID NO: 444452
  misc_feature: HEFZJCU01BOP2L.47.24.C02.1.454.heavy.3.raw

SEQ ID NO: 461811 - DNA, 507 bp, Homo sapiens
  misc_feature: HEFZJCU01CWFX9.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgacttactggggccagggaaccctggtcatcgtctcctcagcctccaccaagggcccatcggtcttcccctggcaccctcctccaagagcacctctgggggcacagcggccctgggctgcctggtcaaggactacttccgagtagtaca

SEQ ID NO: 461812 - DNA, 510 bp, Homo sapiens
  misc_feature: HEFZJCU01EOCNU.2.33.C11.1.454.heavy.3.raw
acgctcgacacacgaccggtgctcgatttagagtgagctcgttgggtttggggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaatgaacagcctggaagacgcggacacagccatgtattattgtacattaggacactatagtccctggggccagggaaccctccg

SEQ ID NO: 461813 - DNA, 504 bp, Homo sapiens
  misc_feature: HEFZJCU01EX387.9.33.C11.1.454.heavy.3.raw
tgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcggtcttccccctggcgccctgctccaggagcacctccgagagcacagcggccctgggctgcctggtcaaggactacttccagacgtatca

SEQ ID NO: 461814 - DNA, 528 bp, Homo sapiens
  misc_feature: HEFZJCU01A7W1M.40.70.G04.1.454.heavy.3.raw
tctagcgactcacgaccggtgctcgatttagtgtagtgtgaagggaaagggggctttctgagagtcatggatctcatgtgcaagaaaatgaagcacctgtggtccttcctcctgctggtggcggctcccagatgggtcctgtcccagctgcagctgcaggagtcgggcccaggactggtgaagccttcggagaccctgtccctcacctgcactgtctctggtgcctccatcagcagtactagttactactggggctggatccgccagtccccagggaagggactggagtggattgcggctatttcttatagtgagaacacctactacaacccgtccctcaagagtcgagtcaccatatccgtagacacgtccaacaaccagttctccctgaacctgagccctgtgaccgtcgcagacacggctgtatattattgtgggagacgctttcgtgacttaggccctgactacggtcggcccccataccgaggacgatttcctcggtatggacgtctggggccaagggacccg

SEQ ID NO: 461815 - DNA, 399 bp, Homo sapiens; identical to SEQ ID NO: 445625
  misc_feature: HEFZJCU01BW0G0.53.42.D09.1.454.heavy.3.raw

SEQ ID NO: 461816 - DNA, 533 bp, Homo sapiens
  misc_feature: HEFZJCU01A1BVA.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccattttgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgatttttgtgtgaaagatacgaagtctatgatacccaatttgggaggggcctttcatgtctggggccaagggacgctggtcaccgtctcttcagcctccaccaaggcccatcggtcttcccctggcaccctcctccagagcacctctgggggcac

SEQ ID NO: 461817 - DNA, 509 bp, Homo sapiens
  misc_feature: HEFZJCU01EA8C4.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtcctactttgactactgggccagggaactctggtcaccgtctccgcagcctccacaagggcc

SEQ ID NO: 461818 - DNA, 515 bp, Homo sapiens
  misc_feature: HEFZJCU01CCCUL.9.70.G04.1.454.heavy.3.raw
tgatacgtctcacgaccggtgctcgatttagtgtagtgtgaagggaaagggcctgtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaaactcctactacggtctggacgtctggggccaggggaccaagggtcaccgtctcctcagcctccaccaagggcccatcggtcttcccctggcgccctgctccaggagcacctccgagagcacagcggccctgggctgcctggtcaaggactacttccagacgtatca

SEQ ID NO: 461819 - DNA, 506 bp, Homo sapiens; identical to SEQ ID NO: 445682
  misc_feature: HEFZJCU01BXKA1.48.44.D11.1.454.heavy.3.raw

SEQ ID NO: 461820 - DNA, 508 bp, Homo sapiens
  misc_feature: HEFZJCU01DK4EO.22.86.H09.1.454.heavy.3.raw
acatacgcgtcacgaccggtgctcgatttagtgctatagacttgggtttgggctgagcgtgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctgggccaagggacactggtcaccgtctcttcagcctccaccaagggcccatcggtcttccccctggcgccctgctccaggacg

SEQ ID NO: 461821 - DNA, 495 bp, Homo sapiens
  misc_feature: HEFZJCU01A6YDB.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggccggttctccatctccagagacaattccaagaacacgctgtatctgcaattgaacagcctgagagccgaggacacggccgtatattactgtgcgaaagagtttggggaatggaccacgtc

SEQ ID NO: 461822 - DNA, 536 bp, Homo sapiens
  misc_feature: HEFZJCU01EDV5P.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatcccctgaaagcgtcaactactactactacggtatggacctctgggccg

SEQ ID NO: 461823 - DNA, 526 bp, Homo sapiens
  misc_feature: HEFZJCU01CV2DC.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccagagcacctccgagagcacagcggccctgggctgcctggtcaaggactacttccacg

SEQ ID NO: 461824 - DNA, 557 bp, Homo sapiens
  misc_feature: HEFZJCU01AWFGY.13.40.D07.1.454.heavy.3.raw
tcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccaggggggggcctggagtggcttggaagcatctctcaaagcgggacgaccgactataacccgtcttttaggagtcgagtctcgatttcaatagacaggtctaagacacaattctccctgagggtgacctctatgtcggccgcggacgcggccgtctattactgtgcgcgaggatctccgtcggaacacttcgtgacaaggcaaacgtccgaagtcgttatcacttgactcctgggccgagggaaccctggtcagcgtctcttcagcctccaccaacgggcccatccggtccttccccctcggccaccctcctcccaagacgcacctcgtggggggcacgacgccgggcccgtcggggcctcggcctc

SEQ ID NO: 461825 - DNA, 533 bp, Homo sapiens
  misc_feature: HEFZJCU01CQ1MU.17.34.D01.1.454.heavy.3.raw
cgtagactagcacgaccggtgctcgatttagatcgtctgtgttgggtttggggacaaaacaaccagattcctcctctaaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgttgcgaggagtaattataataacaactgctcctttttacacctcccttgacttctggggccatggaaccccggtcaccgt

SEQ ID NO: 461826 - DNA, 389 bp, Homo sapiens; identical to SEQ ID NO: 457462
  misc_feature: HEFZJCU01CFTSC.51.49.E05.1.454.heavy.3.raw

SEQ ID NO: 461827 - DNA, 511 bp, Homo sapiens
  misc_feature: HEFZJCU01C3JAU.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggcgtgtttattactgtacgaaaggaggggggatacgagtggcagctccaagtacttacg

SEQ ID NO: 461828 - DNA, 517 bp, Homo sapiens
  misc_feature: HEFZJCU01CH1O6.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccaggcgggagtccaagtactccg

SEQ ID NO: 461829 - DNA, 511 bp, Homo sapiens
  misc_feature: HEFZJCU01EZA10.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccagggaacccg

SEQ ID NO: 461830 - DNA, 523 bp, Homo sapiens
  misc_feature: HEFZJCU01EL5DF.10.85.H08.1.454.heavy.3.raw
catagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatattttctgtgcgagggggagccgggctatggttcggacctctgggggccaggggaacccctgggt

SEQ ID NO: 461831 - DNA, 520 bp, Homo sapiens
  misc_feature: HEFZJCU01DAY6F.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggcctgtattactgtgcgagagatggggcccacgaaacgttacctacgcctatggacgtcgtggggccaagggga

SEQ ID NO: 461832 - DNA, 508 bp, Homo sapiens
  misc_feature: HEFZJCU01BY8VO.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaatagaacaatctgagagtcgacgatacggctgtctatcattgtgttttcgatgccttcggtccgcggacttctggggccagggacctc

SEQ ID NO: 461833 - DNA, 495 bp, Homo sapiens
  misc_feature: HEFZJCU01EQOPK.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccaagagcacctctgggggcacagcggccctgggctgcctggtcaaggatacttccgagtagtaca

SEQ ID NO: 461834 - DNA, 524 bp, Homo sapiens
  misc_feature: HEFZJCU01AR09E.4.1.A01.1.454.heavy.3.raw
agcactgtagcacgaccggtgctcgatttagacgtctcatcaggggtcccaacaaccacatccctcctcagaagcccccagagcacaacacctcaccatggactggacctggaggatcctctttttggtggcagccccccccagccacaggtgtccactcccaggtccaacttgtgcagtctgaggctgaggtgaagacgccaggggcctcagtcaagatttcctgtaaggcctctggatatacgttcattaactatgctatccattgggtgcgccaggcccccggacaaaacctgacgtggatgggttggatcaatggtgaaactggaaaaaccaaatattcaccgagcttccagggcagaatgaccatctcccgggacacatccgcgagcgcaatctatctggaactgagccgcctgacatctgcagactcggcagtatatttctgtgcgagagaggggaggatggttgaggggaattgttaattccatacttactttgaccactggggccaggggtaaccc

SEQ ID NO: 461835 - DNA, 496 bp, Homo sapiens
  misc_feature: HEFZJCU01EP03O.51.53.E09.1.454.heavy.3.raw
cgatcgtatacacgaccggtgctcgatttagagagagtgtgttgggtttgggaggcctggtacagcctggcaggtccctgagactctcctgtgcagcctctggattcaccttttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttcccctggcaccctcctccaagagcacctctgggggcacagcggccctgggctgcctggtcaaggactacttcctcgtagcact

SEQ ID NO: 461836 - DNA, 528 bp, Homo sapiens
  misc_feature: HEFZJCU01DTYTV.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgagacacgggcttctacttctgtgcgaggagtaattactataacactgctccttttacacctcccttcgacttctgggccatggaccccggtaccg

SEQ ID NO: 461837 - DNA, 502 bp, Homo sapiens
  misc_feature: HEFZJCU01EG3FV.51.40.D07.1.454.heavy.3.raw
cgatcgtatacacgaccggtgctcgatttagtgatagagcgtaacaacagagggggctctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtctgggggaggcgtggtccagcctgggaggtccctgagactctcctgtgtagtctctggattcaccttcagggtgtacgacatgcactgggtccgccaggctccaggcaaggggctggagtgggtggcatttatatcacatgatggaagtaaaacatactatgcagagtccgtgaagggccgattcacatctccagagacaattccaagaacacactgtttctgcacatgaaaagcctgagagctgaggacacggctgtttattactgtgcgaacttaatcacggagacaaacc

SEQ ID NO: 461838 - DNA, 519 bp, Homo sapiens
  misc_feature: HEFZJCU01CP8OK.10.59.F04.1.454.heavy.3.raw
catagtagtgcacgaccggtgctcgatttagtacacacacttagggattgggggctttctgagagtcatggacctcctgtgcaagaacatgaatcacctgtggttcttcctcctgctggtggcggcccccagatgggtcctgtcccagctgcagctgcatgagtcgggcccaggactggtgaggccttcggataccctgtccctcagttgcgctgtctctggtggctccatcaacagtggtgacaactggtggggctgggtccgccagcccccagggatgggactggagtggattggcctttacacattatagtgggactaccccactacaacccgtccctcaggagtcgagtcaccatctcactagacacgtccaggaatcacctctccctgacggtgacctctgtgaccgccgcggacacggccgtgtattattgtgcgagagaccccgctgaagattcctcaatgtactttgaccactggggccaggggagccctgggtcaccggtctccctcacg

SEQ ID NO: 461839 - DNA, 501 bp, Homo sapiens; identical to SEQ ID NO: 457766
  misc_feature: HEFZJCU01CKMY7.11.27.C05.1.454.heavy.3.raw

SEQ ID NO: 461840 - DNA, 521 bp, Homo sapiens
  misc_feature: HEFZJCU01EDU5A.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctctttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactaacgctatggacgtcgtggggccaagggaccg

SEQ ID NO: 461841 - DNA, 503 bp, Homo sapiens
  misc_feature: HEFZJCU01CHEL5.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagaggagctattatctcggaaccccgatgt

SEQ ID NO: 461842 - DNA, 483 bp, Homo sapiens; identical to SEQ ID NO: 444532
  misc_feature: HEFZJCU01CR26S.47.59.F04.1.454.heavy.3.raw

SEQ ID NO: 461843 - DNA, 509 bp, Homo sapiens; identical to SEQ ID NO: 444586
  misc_feature: HEFZJCU01CM5LW.12.78.H01.1.454.heavy.3.raw

SEQ ID NO: 461844 - DNA, 489 bp, Homo sapiens
  misc_feature: HEFZJCU01AIQC0.16.67.G01.1.454.heavy.3.raw
tgtactactccacgaccggtgctcgatttagagtatacatattgggtccctgagactctcctgtgcgacctctggattcacctttagcagctatgccatgagctgggtccgccaggctccagggaaggggctggagtgggtctcaactattagtggtagtggtggtaccacatacttcgctgactccgtgaagggccggttctccatctccagagacacttccaagaacacggtgtatctgcaagtgcacagcctgagagccgaggacacggccatatattactgtgcgaaagatcgattccccctccgtagagatggctacaaaatctttctccgaattgacttctggggccagggaaccctggtcaccgtctcctcagcctccaccaagggcccatccggtcttccccctggcaccctcctccaagagcacctctgggggcacagcggccctgggctgcctggtcaaggactactccgagtagtaca

SEQ ID NO: 461845 - DNA, 502 bp, Homo sapiens
  misc_feature: HEFZJCU01ACOJE.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggcctaagggacc

SEQ ID NO: 461846 - DNA, 522 bp, Homo sapiens
  misc_feature: HEFZJCU01E1A8C.12.75.G09.1.454.heavy.3.raw
atacgacgtacacgaccggtgctcgatttagtatagacatcaggggccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattaccgcggacgaatccacgaccacagcctacatagagctgcgcagcctgagatctgaagacacggccatttattacttgtgcgagagagtgcagggcccgtaccccaccatcggtttattttcgttttcgtacttaccctcgggggtcccgacggggaaacccgtcgggtctacccgtccgtccctt

SEQ ID NO: 461847 - DNA, 508 bp, Homo sapiens; identical to SEQ ID NO: 445230
  misc_feature: HEFZJCU01DAELR.14.25.C03.1.454.heavy.3.raw

SEQ ID NO: 461848 - DNA, 511 bp, Homo sapiens; identical to SEQ ID NO: 445840
  misc_feature: HEFZJCU01EGJQV.11.13.B02.1.454.heavy.3.raw

SEQ ID NO: 461849 - DNA, 505 bp, Homo sapiens
  misc_feature: HEFZJCU01C0QCC.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgaggctgtgagcgccgcagacacggccgtgtattactgtgcgagactggccgcaacagactacggtggcaactcctaatgcttttgattatcgtggggccaaaggggacc

SEQ ID NO: 461850 - DNA, 509 bp, Homo sapiens
  misc_feature: HEFZJCU01B5941.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgacttctggggccgagggacg

SEQ ID NO: 461851 - DNA, 519 bp, Homo sapiens
  misc_feature: HEFZJCU01CV2YI.9.34.D01.1.454.heavy.3.raw
tgatacgtctcacgaccggtgctcgatttagatcgtctgtgttgggtttgggggaggcttggtccagcctggggagtccctgcgactctcctgtgtgggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactgggggccgggaaccctggtcgccgtctcctcagcctccaccaagggccatcggtcttccccctggcaccctcctccaagagcacctctgggggcacagcggccctgggctgcctggtcaaggactacttccagacgtatca

SEQ ID NO: 461852 - DNA, 526 bp, Homo sapiens
  misc_feature: HEFZJCU01CR0VA.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactacgtgggggttcgacccctggggccagggaaccctggtcaccgtctcctcagcctcaccg

SEQ ID NO: 461853 - DNA, 525 bp, Homo sapiens
  misc_feature: HEFZJCU01D1R5P.53.10.A10.1.454.heavy.3.raw
cgcgtatacacacgaccggtgctcgatttagcgtcgatctcaggggtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgccctccagggggacctttggggtttcgaccctggggccagggaaccctggtcaccgtctcctcagcctccaccaagggcccatcggtcttccccctggcaccctcctccaagagcacctcg

SEQ ID NO: 461854 - DNA, 488 bp, Homo sapiens; identical to SEQ ID NO: 447044
  misc_feature: HEFZJCU01C6SFJ.18.70.G04.1.454.heavy.3.raw

SEQ ID NO: 461855 - DNA, 497 bp, Homo sapiens; identical to SEQ ID NO: 458817
  misc_feature: HEFZJCU01BB6UR.53.4.A04.1.454.heavy.3.raw

SEQ ID NO: 461856 - DNA, 538 bp, Homo sapiens
  misc_feature: HEFZJCU01CZRTU.53.68.G02.1.454.heavy.3.raw
cgcgtatacacacgaccggtgctcgatttagtcgatagtgaagggaaaggggcacaagaacatgaaacacctgtggttcttcctcctcctggtggcagctcccagatgggtcctgtcccaggtgcagctgcagcagtggggctcaggactgttgaagccttcggagaccctgtccctcacgtgcgctgtctatggtgggtcattcagtgattattattggacctggatccgccaggccccagggaaggggctggagtggatagcggaaatcaatcatagtggaaagactacctacaacccgtccctcaagagtcgagtcaccttatcggtagacacgcccaagaagcagttctccctgagggtgacgtctgtgaccgccgcggacacggctgtctattactgtgcgagaggccccttagtttcggttttggactggttctcccatggaatccctactttgagtactggggccgcggagccctggtcaccgtctcctcagcctccaccaagggcccatcggtcttccccctggccacct

SEQ ID NO: 461857 - DNA, 501 bp, Homo sapiens
  misc_feature: HEFZJCU01CUIIS.51.27.C05.1.454.heavy.3.raw
cgatcgtatacacgaccggtgctcgatttagacgcgatcgaagggtttgggggctctgggagaggagccccagccctgagattcccaggtgtttccattcagtgatcagcactgaacacagaggactcaccatggagttgggactgagctggattttccttttggctattttaaaaggtgtccagtgtgaagtgctactggtggagtctgggggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggta

SEQ ID NO: 461858 - DNA, 528 bp, Homo sapiens
  misc_feature: HEFZJCU01EP0FW.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactactgggggttcgaccccgtggggccgagggaaccctggtcaccgtctcctcagcctccaccg

SEQ ID NO: 461859 - DNA, 538 bp, Homo sapiens
  misc_feature: HEFZJCU01C52R5.51.26.C04.1.454.heavy.3.raw
  modified_base (515)..(515): a, c, t, g, unknown or other
cgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacgggagttacttcctccgcaacggtatggacgtctggggccaaagggaccacggtcaccggtcctccttagcctccaccaagggcccatccggtcttccccctggccnccctcctccaagagtcacctctc

SEQ ID NO: 461860 - DNA, 519 bp, Homo sapiens
  misc_feature: HEFZJCU01C27AF.26.71.G05.1.454.heavy.3.raw
agactatactcacgaccggtgctcgatttagtgtcgtcgcaagagagaggggggggggaagaggaagactgacggtcctgcgctggtggagcccacgcagaccctcacgctgacctgctccgtctctggattctcactcaccacgactgaggtgaatgtggcctgggtccgtcaggcccccggaaaggccctggagtggcttgcactcatttactggagtgatctcaagcggtacaatccgtctctgaggaatcgactcaccatcaccagggacacctccaaagaccgggtggtccttacaatgaccgacatgaatcctgtggacacaggcacatattactgtgcacacagtcctagcggctacgcgagaaaagaatatgactattggggccagggaattttggtcaccgtctccccagcctccaccaagggcccatcggtcttccccctggcgccctgctccaggagcacctccgagagcacagcggccctgggctgcctggtcaaggactacttcct

SEQ ID NO: 461861 - DNA, 508 bp, Homo sapiens
  misc_feature: HEFZJCU01DZOFH.9.12.B01.1.454.heavy.3.raw
tgatacgtctcacgaccggtgctcgatttagtagtgtagattccgcgggggcagctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagcctgggggtccctgaaactctcctgtgcagcctctggatacaccgtcagtagtaactccatgaactgggtccgccaggctccagggaaggggctggagtgggtctcagttatttatagcggtggtaacacatactacgcagactccgtgaagggcagattcaccatctccagagacaattccaggaacacgctgtatcttcaaatgaacagcctgagagtcgaggacacggctgtatattactgtgcgagagatgtgtacgcttttgatatctggggaccg

SEQ ID NO: 461862 - DNA, 400 bp, Homo sapiens; identical to SEQ ID NO: 444452
  misc_feature: HEFZJCU01CD1H5.47.24.C02.1.454.heavy.3.raw

SEQ ID NO: 461863 - DNA, 504 bp, Homo sapiens; identical to SEQ ID NO: 446672
  misc_feature: HEFZJCU01CRCDV.10.38.D05.1.454.heavy.3.raw

SEQ ID NO: 461864 - DNA, 522 bp, Homo sapiens
  misc_feature: HEFZJCU01DN428.11.12.B01.1.454.heavy.3.raw
cgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctgggaccaagggaccg

SEQ ID NO: 461865 - DNA, 508 bp, Homo sapiens
  misc_feature: HEFZJCU01EJ0JH.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatccctccgggacagacttaccatgaccacgaactcctccataaacacagcctacatggagttgaggagcctgacatctgacgacacggccgtctattactgtgcgagagtcccacgatccggtgacgcctacggccagcggcctttgaccttcgtc

SEQ ID NO: 461866 - DNA, 500 bp, Homo sapiens
  misc_feature: HEFZJCU01A9TD1.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagttttgggctgagcgtgggttttccgtcgttagctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacgggctgtgtattactgtgcgaaagattttctatagaggtga

SEQ ID NO: 461867 - DNA, 488 bp, Homo sapiens
  misc_feature: HEFZJCU01CJE0F.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccagtctccaggcaaggggctgcagtgggtggcgtttattcgaagcgatgggactcatgaacaatatgcagactccgtgaagggccgattcatcatctccagagacaactccaacaacacactggatctccaaatgaacagcctgagagtcgaggacacggccgtatatttattgtgcccttgattacta

SEQ ID NO: 461868 - DNA, 512 bp, Homo sapiens; identical to SEQ ID NO: 445688
  misc_feature: HEFZJCU01CPT9K.3.34.D01.1.454.heavy.3.raw

SEQ ID NO: 461869 - DNA, 514 bp, Homo sapiens
  misc_feature: HEFZJCU01BQYTK.16.21.B10.1.454.heavy.3.raw
tgtactactccacgaccggtgctcgatttagtgtcgtcgcaggagagaggaggcccacgccctcgggagttttctaggtggttttctatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactgggg

SEQ ID NO: 461870 - DNA, 520 bp, Homo sapiens; identical to SEQ ID NO: 453029
  misc_feature: HEFZJCU01EBQPJ.16.86.H09.1.454.heavy.3.raw

SEQ ID NO: 461871 - DNA, 504 bp, Homo sapiens
  misc_feature: HEFZJCU01CLV4M.13.37.D04.1.454.heavy.3.raw
tcacgtactacacgaccggtgctcgatttagtagcatactgttgggtttgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaagatattgtaatgatggtagctgctactacactttttgactactggggccagggaaccctggtcaccgtctcttcagcctccaccaagggcccatcggtcttcccctggcaccctcctccaagagcacctctgggggcacagcggcctgggctgcctggtcaaggactacttcctagtacgtga

SEQ ID NO: 461872 - DNA, 513 bp, Homo sapiens
  misc_feature: HEFZJCU01DDVGW.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgagggccgattccaccatctccagagacaattccaagaacacgctgtttctcaaatgaacagcctgagagccgatgacacggccgtgtattactgtgcgagagatggggcccacgaacgttactacgctatggacgtctggggaccg

SEQ ID NO: 461873 - DNA, 470 bp, Homo sapiens; identical to SEQ ID NO: 444866
  misc_feature: HEFZJCU01BA1VG.4.36.D03.1.454.heavy.3.raw

SEQ ID NO: 461874 - DNA, 520 bp, Homo sapiens
  misc_feature: HEFZJCU01D76QU.48.35.D02.1.454.heavy.3.raw
agtatacatacacgaccggtgctcgatttagcacacgatagttgggtttggggggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactgggcctggatccgccagccccccgggaagggactggaatggattgggagtatctattatacagggagcacctactacaacccgtccctcaagagtcgagtcaccatctccgcagacacgtccaagaaccagttctccctgaggctgagctctgtgaccgccgcagacacggctgtctattactgtgcgagaagtgggtcgtggcagtggctggtacgtggctctcagtggttcgacccctggggccaggggatacctggtcaccgtctcctcagcttccaccaac

SEQ ID NO: 461875 - DNA, 520 bp, Homo sapiens
  misc_feature: HEFZJCU01CDTML.48.33.C11.1.454.heavy.3.raw
agtatacatacacgaccggtgctcgatttagagtgagctcgttgggactgagctggattttccttttggctattttaaaagctgtccagtgtgaagtgcacctggtggagtctgggggaggcttggtacagcctggcaggtccctgagactctcctgtgcagcctctggattcacctttgatgattatgccatgcactgggtccggcaagttccagggaagggcctggagtgggtctcaggcattagtagaattaggggtagcatagcctatgcggattctgtgaagggccgattcaccatctccagagacaacgccaagaactccctgtatctgcaaatgaacagtctgagacctgaggacacggccttctattactgtgcaaaagatcaggcattagactacaacggtatggacgtcgtggggccaagggatcacggtcaccgtctcctcagcctccaccgaacgggcccactcggtccttcccccgtggccaccctcctccaagacgccacctcgtc

SEQ ID NO: 461876 - DNA, 499 bp, Homo sapiens; identical to SEQ ID NO: 446805
  misc_feature: HEFZJCU01DM7FS.3.20.B09.1.454.heavy.3.raw

SEQ ID NO: 461877 - DNA, 503 bp, Homo sapiens
  misc_feature: HEFZJCU01EET7M.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttatttaggaccagctgttaaaactctactacgtctggacgtctgggcc

SEQ ID NO: 461878 - DNA, 508 bp, Homo sapiens
  misc_feature: HEFZJCU01AS9K3.13.39.D06.1.454.heavy.3.raw
tcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctggggccaagggaccacggtcaccgtctcctcagcctcaccaagggcccatcc

SEQ ID NO: 461879 - DNA, 541 bp, Homo sapiens
  misc_feature: HEFZJCU01D99MQ.17.28.C06.1.454.heavy.3.raw
  modified_base (527)..(527): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggtccgtttcaccatctccagagacaacgccaagaattcactgtatctacaactgaacagcctgagagtcgcagacacggccgtgtattactgtgcgagatggtaggaaaagtaatggctgttgtttagttggggccagggancccgtggtccaccg

SEQ ID NO: 461880 - DNA, 524 bp, Homo sapiens
  misc_feature: HEFZJCU01BMHV1.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgactgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggccaggggaccctggtcatcgtctccccagcctccaccaagggcccatcggtcttccccctggccg

SEQ ID NO: 461881 - DNA, 461 bp, Homo sapiens; identical to SEQ ID NO: 454373
  misc_feature: HEFZJCU01ENAF8.4.82.H05.1.454.heavy.3.raw

SEQ ID NO: 461882 - DNA, 512 bp, Homo sapiens
  misc_feature: HEFZJCU01B1BOV.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctgcgatctgacgacgcggccgtatattactgtgcgagagtacgtagcgctcgtcctttgactactggggcctgggaactctggtcaccgtct

SEQ ID NO: 461883 - DNA, 511 bp, Homo sapiens
  misc_feature: HEFZJCU01AEUP9.49.33.C11.1.454.heavy.3.raw
agtcgagagacacgaccggtgctcgatttagagtgagctcgttgggtttgggggaggcgtggtccagcctgggaggtccctgagactctcctgtgtagtctctggattcaccttcagggtctatgacatgcactgggtccgccaggctccaggcaaggggctggagtgggtggcagttatatcaaatgatgcaagtaacaaatactatgtagactccgtgaagggccgattcaccatctccagagacaattccaagaatacgctgtatctgcacatgaacagcctgagagccgaagacacgggtgtttattactgtgcgaacttaattacggaggacaacggtaaccccgtcgcacggtacggacgtctgggggccaagggaccacggtcaccgtctcctcagcctccaccaagggcccatcggtcttccccctggcaccctcctccaagagcacctctgggggcacagcgccctgggctgcctggtcaaggactacttcctctctcgact

SEQ ID NO: 461884 - DNA, 488 bp, Homo sapiens
  misc_feature: HEFZJCU01DLI7P.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctccccaccctccaccaaggcccatcggtcttcccctggcaccctcctccaagagcacctctgggggcacagcggccctgggctgcctggtcaaggactacttcccatactcgta

SEQ ID NO: 461885 - DNA, 506 bp, Homo sapiens; identical to SEQ ID NO: 444696
  misc_feature: HEFZJCU01DBFPZ.16.34.D01.1.454.heavy.3.raw

SEQ ID NO: 461886 - DNA, 489 bp, Homo sapiens
  misc_feature: HEFZJCU01B20TV.4.53.E09.1.454.heavy.3.raw
  modified_base (484)..(484): a, c, t, g, unknown or other
agcactgtagcacgaccggtgctcgatttagagagagtgtgttgggtttggggggtccctgagactctcctgtacagtctctgcatctaccttcacttctttttggatgacctggctccgccgggctccagggaggggctggagtgggtggccaccatcaatcaagatggaagtgagagaacctatgtggactctgtgaagggccgattcaccatctccagagacaacgccaagaattctctgtatctgcaaatgaacagcctgagagccgaggactcggctgtctattactgtgcgaggaagaagtattactatgatacaagtgacatgggctggttcgacccctggggccagggaaccctggtcaccgtctcctcagcctccaccaagggcccatcggtcttccccctggcgccctgctccaggagcacctccgagagcacagcggccctcgggctgcctggtcaaggactacttccctacngtgct

SEQ ID NO: 461887 - DNA, 501 bp, Homo sapiens; identical to SEQ ID NO: 456568
  misc_feature: HEFZJCU01D3OH1.47.38.D05.1.454.heavy.3.raw

SEQ ID NO: 461888 - DNA, 522 bp, Homo sapiens; identical to SEQ ID NO: 449550
  misc_feature: HEFZJCU01A8TFN.12.40.D07.1.454.heavy.3.raw

SEQ ID NO: 461889 - DNA, 511 bp, Homo sapiens
  misc_feature: HEFZJCU01EYCIU.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggcgttttcttaggtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgcgaaagatctcgggctggttccgcggtccgggt

SEQ ID NO: 461890 - DNA, 527 bp, Homo sapiens
  misc_feature: HEFZJCU01CAEZ2.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatctatgggggcttgttctggggccaggggaccctggtcatcgtctccccagcctccaccaagggcccatcggtcttccccctggccgcctcg

SEQ ID NO: 461891 - DNA, 543 bp, Homo sapiens
  misc_feature: HEFZJCU01AFOBV.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggctttttcttgtggctttttaaaaggtgcccagtgtgaggtgcaactgttggagtctgggggaggcttggtacagccggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaacactgtatctgcaattaaccagcctgagagtcgaggacacggccctttattactgtgcgaaggatcgcccctataatggtgttggatcggggagtttggttccgtggggccagggaaccctggtctaccg

SEQ ID NO: 461892 - DNA, 521 bp, Homo sapiens
  misc_feature: HEFZJCU01CJ7RQ.40.81.H04.1.454.heavy.3.raw
  modified_base (423)..(423): a, c, t, g, unknown or other
tctagcgactcacgaccggtgctcgatttagtagtgtagattcgcggggcagcaaccacatctgtcctctagagaatcccctgagagctccgttcctcaccatggactggacctggaggtatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgaggtggatggggtggatcaaccctaccagaggtggcacaaagtatcgacagaactttcagggcagggtcaccatgacctgggacgcgtccatcagcacagtctacatggatctgagcggactgacctntgacgacacggccatgtattactgtaggaagagacgttggtggctaccggcggggtctggaccacggtcgggggccacggggaaccccgtggtacccg

SEQ ID NO: 461893 - DNA, 510 bp, Homo sapiens
  misc_feature: HEFZJCU01C0GB8.12.30.C08.1.454.heavy.3.raw
atacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtggctccatcagcagtggtgattattactggagttggatccgccagtcccccagggaagggcctggagtggattgggtacatctatcacagtgggagcacctactacatcccgtccctgaagagtcgaattacgatgtcagtaaacacgtctaggaaccagttctccctgaagctgaggtctgtgactgccgcagacacggccgtctactactgtgccaggtgggctttgcgccagtggttcagagatgatcgcttccgattcgtggggccagggaatttcg

SEQ ID NO: 461894 - DNA, 502 bp, Homo sapiens
  misc_feature: HEFZJCU01CIDMJ.40.35.D02.1.454.heavy.3.raw
tctagcgactcacgaccggtgctcgatttagcacacgatagttgggtttgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtgggccaagggacaatggtcaccgt

SEQ ID NO: 461895 - DNA, 530 bp, Homo sapiens
  misc_feature: HEFZJCU01ECXBJ.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagttttggctgagctgggttttccttgttgctatttcaaaaggtgtccactgtgaggagcagttggtggagactggaggaagcctgatccagccggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccgattcaccatctccagagacgattccaagaacacgttgtatcttcaaatgaacagcctgacagtcgacgacacggccatgtatttttgtgtcgagcggacccgggggctccctcaatggtctttcgattacctggggcccaggggtaaa

SEQ ID NO: 461896 - DNA, 494 bp, Homo sapiens
  misc_feature: HEFZJCU01DJ0ZE.11.71.G05.1.454.heavy.3.raw
cgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttattcatatgatggaaatagtgacttctattcagactccgtgaagggccgattcaccgtctccagagacaattccaggcacacgctgtatctgcaaatgaacagcctgagagctgaggacacggctgtgtattactgtgacgaaagtatttctata

SEQ ID NO: 461897 - DNA, 424 bp, Homo sapiens
  misc_feature: HEFZJCU01D0ZHI.16.78.H01.1.454.heavy.3.raw
tgtactactccacgaccggtgctcgatttagtgtgagtagtttgggtttgggctcaactctcttgtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcgggggactacctcgacccctggggccagggaatactggtcaccgtctcctcagcctccaccaagggcccatcggtcttccccctggcaccctcctccaagagcacctctgggggcacagcggccctgggctgccctggtcaaggactacttccgagtagtgca

SEQ ID NO: 461898 - DNA, 531 bp, Homo sapiens
  misc_feature: HEFZJCU01BCE6K.22.11.A11.1.454.heavy.3.raw
acatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccagggaaggggctggagtggatctcagttatttatctcggtggtaacacatactacgcagactccgtggagggccgattcaccatctccagagacaattccaagaacacggtgtatcttcaaatgaacagcctgagagccgatgacacggccgtgtattactgtgtgagatcaaaattccaagccgcgggggtcgacccaaattgactactggggccagggaacccgtggtcaccgtcctcctccagcctccaccaaggcccatcggtcttccccctcggccgccctcgctccac

SEQ ID NO: 461899 - DNA, 522 bp, Homo sapiens
  misc_feature: HEFZJCU01AQCP0.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatgggtctcagttattcataccgacggtaccatatatgacgcagactccgtgaagggccgattcaccatctccagagaccattccaagaacaccctatatcttcaaatgaacaacctgagagtcgaagacacggccgtatattactgtgcgagacatgacttcggtgaccccgtggggccaggggaaccctggtcaccgtctcctcacg

SEQ ID NO: 461900 - DNA, 502 bp, Homo sapiens
  misc_feature: HEFZJCU01EO7L4.11.19.B08.1.454.heavy.3.raw
cgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtctgggggaagcttggtacagcctggagggtccctgagactcttctgtgcagcctctggattcgactttagtagttatgaaatgaactgggtccgccaggctccagggaaggggctggagtgggtttcatacatttctagtaattctggtaccatacactatgcagtctctgtgaagggccgattcaccatctccagagacaacgccaggaactcactttatctgcaaatgagcagcctgagagtcgaggacacgggtatttattactgtgcgagagatagtctgtctatgcgttccgggagctaa

SEQ ID NO: 461901 - DNA, 408 bp, Homo sapiens
  misc_feature: HEFZJCU01A0TW8.49.43.D10.1.454.heavy.3.raw
agtcgagagacacgaccggtgctcgatttagactagcagtaaggggctggagtgggtctctgccattagtggaagtggtgatctcagatactacggagactccgtgaagggccggttcaccatctccagagacaactccaagaatacgctctatctacacatgaaaaacctaagagccgacgacacggccgtctattactgtgcaaagtgggtcacggactacgatgatactagtggctattactccggtgactactttgactactggggccagggaaccctggtcaccgtctcctcagcctccaccaagggcccatcggtcttccccctggcaccctcctccaagagcacctctgggggcacagcggccctgggctgcctggtcaaggactacttcctctctcgact

SEQ ID NO: 461902 - DNA, 500 bp, Homo sapiens; identical to SEQ ID NO: 444529
  misc_feature: HEFZJCU01AKDX4.12.38.D05.1.454.heavy.3.raw

SEQ ID NO: 461903 - DNA, 486 bp, Homo sapiens
  misc_feature: HEFZJCU01BWU9Q.19.13.B02.1.454.heavy.3.raw
tactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaaccacgctgtatctgcaatgaacagcctgagagctggaggacacggctgtgtattactgtgcgaggcggt

SEQ ID NO: 461904 - DNA, 533 bp, Homo sapiens
  misc_feature: HEFZJCU01AXEGA.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgttgacttttgggccagggaaccctggtcaccgtctcctcagcctccaccaagggcccagtcggtcttcccctggcaccctcctccaagagcacctcgtggggcacgagccgccgtggctcgccgtc

SEQ ID NO: 461905 - DNA, 506 bp, Homo sapiens
  misc_feature: HEFZJCU01DVCYM.49.32.C10.1.454.heavy.3.raw
agtcgagagacacgaccggtgctcgatttagtatagacatcaacacacaaagggggctttctgagagtcatggatctcatgtgcaagaaagtgaagcacctgtggttcttcctcctgctggtggcggctcccagatgggtcctgtcccagctgcagctacaggagtcgggcccaggactgctgaagccttcggagaccctgtccctcacctgcactgtctctggtggttccttcagtagtccttattactactggggctgggtccgccagcccccagggaagggcctggagtggattgcgaatatctactatagtgggagcacctactacaatccttccctcaagagtcgcgtcactgtgtccgtggacacgtccaagaataaagtctccctgaacctgaactctgtgaccgccgcagacacggctgtctattactgtgccagaacgcggaaatccctacacaatgatgcttttgatgtctggggccatgggacaatggtcaccgt

SEQ ID NO: 461906 - DNA, 437 bp, Homo sapiens; identical to SEQ ID NO: 447018
  misc_feature: HEFZJCU01DITFJ.40.27.C05.1.454.heavy.3.raw

SEQ ID NO: 461907 - DNA, 486 bp, Homo sapiens; identical to SEQ ID NO: 444861
  misc_feature: HEFZJCU01ADOEO.47.55.E11.1.454.heavy.3.raw

SEQ ID NO: 461908 - DNA, 520 bp, Homo sapiens; identical to SEQ ID NO: 458346
  misc_feature: HEFZJCU01BBSTR.3.82.H05.1.454.heavy.3.raw

SEQ ID NO: 461909 - DNA, 500 bp, Homo sapiens
  misc_feature: HEFZJCU01DZK5E.49.52.E08.1.454.heavy.3.raw
agtcgagagacacgaccggtgctcgatttagtcgagctctcagagagaaagggaaaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcttctggtggactctgggggaggcgtggtccggcctgggaggtccctgagactctcctgtgcagcctctcagttcaccttcagtgtctatactatgcactgggtccgccaggctccaggcaaggggctggagtgggtggcacttatatcaaatgatggaagaattcaacactacgcaggctccgtgaagggccgattcaccatctccagagacaattccaagaacacactgtctctgcaatgaatagcctgagagttgaggacacggctgtctattactgtgcgagagctaagggacttac

SEQ ID NO: 461910 - DNA, 521 bp, Homo sapiens
  misc_feature: HEFZJCU01BOY7D.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggacggtttttggggcgcggactcctcttgagatctggggccaggggacaatggtcaccgtctcttcag

SEQ ID NO: 461911 - DNA, 470 bp, Homo sapiens; identical to SEQ ID NO: 444866
  misc_feature: HEFZJCU01DGJFB.4.36.D03.1.454.heavy.3.raw

SEQ ID NO: 461912 - DNA, 511 bp, Homo sapiens
  misc_feature: HEFZJCU01D1X7I.13.71.G05.1.454.heavy.3.raw
tcacgtactacacgaccggtgctcgatttagtgtcgtcgcaagagagaggagccttagccctggactccaaggcctttccacttggtgatcagcactgagcacagaggactcaccatggaattggggctgagctgggttttccttgttgctattttagaaggtgtccagtgtgaggtgcagctggtggagtctggggggggcttggtccagcctggggggtccctgagactctcctgtgcagcctctggattcactttttagtaggtattggatgggttgggtccgccagactccagagaagggactggagtggggtggccaacataaaggaagatggaagtgaaagatactatgtggactctgtgaagggccgattcaccatctccagagacaacgccaagaactcactgtatctgcagatgaccagcctgagagtcgaggatacggctgtgtattattgtgcgagagatgggggcacgacattttgtagaggtgtacgtggggccaggg

SEQ ID NO: 461913 - DNA, 512 bp, Homo sapiens
  misc_feature: HEFZJCU01EYE7V.22.36.D03.1.454.heavy.3.raw
acatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacagccgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaagacctctattttgggccgcggccgactactgggccgac

SEQ ID NO: 461914 - DNA, 485 bp, Homo sapiens
  misc_feature: HEFZJCU01D6ZZV.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggacgcacctccgagagcacagcggcctggctgcctgtcaaggctactcctacgtgagct

SEQ ID NO: 461915 - DNA, 500 bp, Homo sapiens
  misc_feature: HEFZJCU01D8VYJ.13.71.G05.1.454.heavy.3.raw
tcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatctgggggaggcgtggtccagcctggggaatccctgacactgtcttgtgtagcctctggattcagcttcagaacctatggcatgcactgggtccgccaggccccaggcaaggggctggagtggctgactcttttatcatatgatggaagtcaaaaattctatgcagactccgtgaagggccgattcaccgtctccagggacaactccaagaacaccttatatctgcagatgaacagcctgagaggtgacgacgtcggctgtatacttctgtgcgaacaaacatgattggtttggaggtggtagtgtgtta

SEQ ID NO: 461916 - DNA, 506 bp, Homo sapiens
  misc_feature: HEFZJCU01DSBWH.10.38.D05.1.454.heavy.3.raw
catagtagtgcacgaccggtgctcgatttagtatctgatagttgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttccccctggcgccctgctccaggagcacctccgagagcacagcggccctgggctgcct

SEQ ID NO: 461917 - DNA, 435 bp, Homo sapiens
  misc_feature: HEFZJCU01ASFRL.16.78.H01.1.454.heavy.3.raw
tgtactactccacgaccggtgctcgatttagtgtgagtagtttgggtttgggctcaacgtctcttgtccgccaggctccagggaagggctggagtgggtctcatccattagtagtagtagtagttacatatattacgcagactcagtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 461918 - DNA, 492 bp, Homo sapiens
  misc_feature: HEFZJCU01CIVBH.11.13.B02.1.454.heavy.3.raw
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagccggccctgggctgcctggtcaaggactacttccgtatctctcg

SEQ ID NO: 461919 - DNA, 396 bp, Homo sapiens; identical to SEQ ID NO: 444469
  misc_feature: HEFZJCU01AXPDV.47.46.E02.1.454.heavy.3.raw

SEQ ID NO: 461920 - DNA, 495 bp, Homo sapiens
  misc_feature: HEFZJCU01CBJM0.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcgccctgctccaggagcacctccgagagcacagcggccctgggctgcctggtcaggactacttccgagtagtaca

SEQ ID NO: 461921 - DNA, 511 bp, Homo sapiens
  misc_feature: HEFZJCU01EQZQD.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgacttctggggccaggggacccg

SEQ ID NO: 461922 - DNA, 518 bp, Homo sapiens
  misc_feature: HEFZJCU01CU3NR.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggccctgggctgcctggtcaaggactacttccagacatatca

SEQ ID NO: 461923 - DNA, 517 bp, Homo sapiens
  misc_feature: HEFZJCU01EZ67M.48.34.D01.1.454.heavy.3.raw
agtatacatacacgaccggtgctcgatttagatcgtctgtgttgggtttggggatttagatgtctgtgttgggtttggggggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttccccctggcgccctgctccaggagcacctccgagagcacagcggccctgggctgcctggtcaaggactacttcctatgtata

SEQ ID NO: 461924 - DNA, 511 bp, Homo sapiens
  misc_feature: HEFZJCU01A59YN.51.30.C08.1.454.heavy.3.raw
cgatcgtatacacgaccggtgctcgatttagtctgacgtcaaagggaaaggggaggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagttgctgggaaggacatactacaggtccaagtggtttaatgattatgcagtatctgtgaaaagtcgaataaccatcaacccagacacatccaagaaccagttctccctgcaactgaactctgtgactcccgaggacacggccgtgtattactgtgcaagaggttggttaacagctggaggatttgactactggggccagggaaccctggtcaccgtctcctcagcctccaccaagggcccatcggtcttcccctggccgccctgctccaggagcacctccgagagcacagcggccctgggcg

SEQ ID NO: 461925 - DNA, 542 bp, Homo sapiens
  misc_feature: HEFZJCU01C3CA6.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattgggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacgggtgactactgggggtttcgaccccgttgggggccacggggaaccctgggtcaccggtctccgtccaggccctccaacccg

SEQ ID NO: 461926 - DNA, 399 bp, Homo sapiens; identical to SEQ ID NO: 444690
  misc_feature: HEFZJCU01C2U7J.4.79.H02.1.454.heavy.3.raw

SEQ ID NO: 461927 - DNA, 531 bp, Homo sapiens
  misc_feature: HEFZJCU01EK3HR.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgtagagcgtcgtctgtcagtggaattgactactgggccagggaaccctggtcaccgtctcctcagcctcaccaaggg

SEQ ID NO: 461928 - DNA, 519 bp, Homo sapiens
  misc_feature: HEFZJCU01EOMTA.52.52.E08.1.454.heavy.3.raw
cgcagtacgacacgaccggtgctcgatttagtcgagctctcagagagaaaggggatactttctgagactcatggacctcctgcacaagaacatgagacacctgtggttcttcctcctcctggtggcagctcccagatgggtcctgtctcaggtgcagctgcaggagtcgggcccaggactggtgaagccttcggggaccctgtctctcacctgcgctgtctctggtgggtccatcagaagtagtaactggtggagttgggtccgccagcccccagggaagggtctggagtggattggggaaatctatcatactgggaacaccaactacagcccgtccctcaagagtcgagtcgccatatcactagaccaggcgaacaacgagttctccctgaaactgagctctgtgaccgccgcagacacggccgtgtattattgtgggagagatcggagagatagtagtggtttttactacggttgactacgacggtatggacgtctggggccaaggggaccacggtc

SEQ ID NO: 461929 - DNA, 523 bp, Homo sapiens; identical to SEQ ID NO: 446270
  misc_feature: HEFZJCU01D3JQR.12.40.D07.1.454.heavy.3.raw

SEQ ID NO: 461930 - DNA, 510 bp, Homo sapiens; identical to SEQ ID NO: 456087
  misc_feature: HEFZJCU01DAYAR.2.16.B05.1.454.heavy.3.raw

SEQ ID NO: 461931 - DNA, 531 bp, Homo sapiens
  misc_feature: HEFZJCU01CCD3N.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggcagggaaccctggtgaccgtctcctcagcctccaccaagggcccatcggtcttccccctggccgccctgctcccaggagcacctccgacgagcacagcggcccgtcgggtcg

SEQ ID NO: 461932 - DNA, 512 bp, Homo sapiens
  misc_feature: HEFZJCU01CSN7S.12.55.E11.1.454.heavy.3.raw
atacgacgtacacgaccggtgctcgatttagcactcgcacgttgggtttgggctgagctgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctgggccgtggcacctggcactgtctcctcggcttccaccaagggcccatcggtcttcccctggccgccctcgctccagagcacctcgg

SEQ ID NO: 461933 - DNA, 518 bp, Homo sapiens
  misc_feature: HEFZJCU01D52F3.52.52.E08.1.454.heavy.3.raw
cgcagtacgacacgaccggtgctcgatttagtcgagctctcagagagaaaggggatactttctgagactcatggacctcctgcacaagaacatgagacacctgtggttcttcctcctcctggtggcagctcccagatgggtcctgtctcaggtgcagctgcaggagtcgggcccaggactggtgaagccttcggggaccctgtctctcacctgcgctgtctctggtgggtccatcagaagtagtaactggtggagttgggtccgccagcccccagggaagggtctggagtggattggggaaatctatcatactgggaacaccaactacagcccgtccctcaagagtcgagtcgccatatcactagaccaggcgaacaacgagttctccctgaaactgagctctgtgaccgccgcagacacggccgtgtattattgtgggagagatcggagagatagtagtggtttttactacggttgactacgacggtatggacgtcgtggggccaagggaccacggc

SEQ ID NO: 461934 - DNA, 503 bp, Homo sapiens
  misc_feature: HEFZJCU01DITCZ.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgtttctgcaaatgaacagcctgagaattgaggactcgggtatatactactgtgcccgtgacccctgactgataaaccggactggttcgacccctggggccaggggaaccctggtcaccgtctcctccg

SEQ ID NO: 461935 - DNA, 429 bp, Homo sapiens; identical to SEQ ID NO: 447944
  misc_feature: HEFZJCU01EW0YH.4.37.D04.1.454.heavy.3.raw

SEQ ID NO: 461936 - DNA, 509 bp, Homo sapiens
  misc_feature: HEFZJCU01AD3A9.49.37.D04.1.454.heavy.3.raw
agtcgagagacacgaccggtgctcgatttagtagcatactgttgggtttgggggaggcgtggtccagcctgggaggtccctgagactctcctgtgcagcctctggattcgtctctagtgtctaccctatgcactgggtccgccaggctccaggcaaggggctggaatgggtggcacttatctcatctggatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctggggccagggagccctggtcaccgtctcctcagcttccaccaagggcccatcggtcttcccctggcgccctgctccaggagcacctctgggggcacagcggccctgggctgcctggtcaaggactacttcctctctcgta

SEQ ID NO: 461937 - DNA, 504 bp, Homo sapiens
  misc_feature: HEFZJCU01CYF2N.14.39.D06.1.454.heavy.3.raw
cgtctagtaccacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtgctccttcagcagtggtagtttctactggagctggatccggcagcccgccgggaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctggggccaagggaccacggtcaccgtctcctcagcctccaccaagggccc

SEQ ID NO: 461938 - DNA, 491 bp, Homo sapiens; identical to SEQ ID NO: 444592
  misc_feature: HEFZJCU01ETETT.11.26.C04.1.454.heavy.3.raw

SEQ ID NO: 461939 - DNA, 511 bp, Homo sapiens
  misc_feature: HEFZJCU01DJHR9.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgttcatctgagggcagtgttcaatggtatgctgacgccgtgaagggcgattcaccatctccagagacaactccaggaacacaatgtatttggacctgaacagcctaagtcctgaggacacgggtgtatactactgtacgaaggagggggaaccaggcggagtccaagtactctttg

SEQ ID NO: 461940 - DNA, 506 bp, Homo sapiens
  misc_feature: HEFZJCU01AJCA3.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctgcgcctgctcagagcactctggggcacagcgccg

SEQ ID NO: 461941 - DNA, 501 bp, Homo sapiens
  misc_feature: HEFZJCU01EH38V.12.79.H02.1.454.heavy.3.raw
atacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgtccactcccaggtgcatctggagcagtctggagctgaggtgaaggagcctggggcctcagtaaaatctcctgcaagtcttctggttacgcactcaccgccaatggtatcagctggctgcgacaggcccctggacaaggtcttgagtggatgtcatggatcagcactttcaatggagacacaaagtatggagagaacttccagggcagagtcaccatgaccactgacagatcaacgaacatagcctacttggaactgaggggcctgaggtctgacgacacggccctctattattgtgcgagaattaatttcgttattgttctggtggtgtgtgttcaatgtttgacc

SEQ ID NO: 461942 - DNA, 505 bp, Homo sapiens; identical to SEQ ID NO: 447076
  misc_feature: HEFZJCU01DN12O.10.38.D05.1.454.heavy.3.raw

SEQ ID NO: 461943 - DNA, 481 bp, Homo sapiens
  misc_feature: HEFZJCU01C53ON.26.78.H01.1.454.heavy.3.raw
agactatactcacgaccggtgctcgatttagtgtgagtagtttgggtttggggagacgagcccagcactggaagtcgccggtgtttccattcggtgatcatcactgaacacagaggactcaccatggagtttgggctgagcgtgggttttccgtcgttgctcttttaagaggtgtccagtgtcaggtgcagctggtggagtctgggggaggcgtggtccagcctgggaggtccctgagactctcctgtgcagcctctggattcaccttcagttactatactatgcactgggtccgccaggctccaggcaaggggctggagtgggtggcagttatatcatatgatggaagcagcacatattacacagactccgtgaagggccgattcaccatctccagagacaatttgaagaacacgctgtatctgcaaatgaacagcctgagagctgaagacacggctgttgttttactgtgcgagagaga

SEQ ID NO: 461944 - DNA, 521 bp, Homo sapiens
  misc_feature: HEFZJCU01ENS4L.18.33.C11.1.454.heavy.3.raw
  modified_base (502)..(502): a, c, t, g, unknown or other
tacgagtatgcacgaccggtgctcgatttagagtgagctcgttgggtttggggggggagaggagcccagcactgggattccgaggtgtttccattcggtgatcagcactgaacacagaggactcaccatggagttttggtcgtgagcgtggattttccttgttggctatttcaaaaggtgtccactgtgaggagcagttggtggagactggaggaagcctgatccagccggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccgattcaccatctccagagacgattccaagaacacgttgtatcttcaaatgaacagcctgacagtcgacgacacggccatgtatttttgtgcgagcgaccggggctcctcaatggcttcnttactgggccagggtaacc

SEQ ID NO: 461945 - DNA, 501 bp, Homo sapiens; identical to SEQ ID NO: 457766
  misc_feature: HEFZJCU01BLCGO.11.27.C05.1.454.heavy.3.raw

SEQ ID NO: 461946 - DNA, 508 bp, Homo sapiens
  misc_feature: HEFZJCU01B8JWT.12.78.H01.1.454.heavy.3.raw
  modified_base (351)..(351): a, c, t, g, unknown or other
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggancgactggttcgacccctggggccagggaaccctggtcaccgtctcctcagcctccaccaagggcccatcggtcttcccctggcaccctcctccaagagcacctctgggggcacagcggcctgggctgcctggtcaaggactacttcctacgtcgtat

SEQ ID NO: 461947 - DNA, 531 bp, Homo sapiens
  misc_feature: HEFZJCU01BBS05.40.38.D05.1.454.heavy.3.raw
tctagcgactcacgaccggtgctcgatttagtatctgatagttgggtttggggatgctttctgagagtcagggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggttggatccgccagcccccagggaaggggctggagtggattgggagtatgcactatagtgggagcacccactacaccccgtccctcaagagtcgagtcaccatatccgtagacacgtccaagaatcagttctccctgaagctgacctctgtgaccgccgcagacacggctgtttattactcgtgtgacgaccgggtgacccgaagaaaaggtctttaatcccgtggggccagggtaaccctggtacctaccggtcctccggtcctaggccctccg

SEQ ID NO: 461948 - DNA, 495 bp, Homo sapiens; identical to SEQ ID NO: 446614
  misc_feature: HEFZJCU01DTTHP.13.85.H08.1.454.heavy.3.raw

SEQ ID NO: 461949 - DNA, 395 bp, Homo sapiens; identical to SEQ ID NO: 445227
  misc_feature: HEFZJCU01ECGZI.47.46.E02.1.454.heavy.3.raw

SEQ ID NO: 461950 - DNA, 507 bp, Homo sapiens
  misc_feature: HEFZJCU01CDF0F.49.77.G11.1.454.heavy.3.raw
agtcgagagacacgaccggtgctcgatttagctagtcactcaagggaaagggtctgtgaagccttcacagaccctgtccctcacctgcgctgtctctggtggctccatcaccagtggtggttattcctggacttggatccggcagccaccagggaaggccctggagtggattgggcacatctatcatagtgggaccacctactacaacccgtccctccagagtcgagtcaccatatcagtcgacatgtccgagaaccagttctccctgtacctccactctgtgaccgccgcggacacggccgtctattactgtgccagaggggaactctacttcggggattaggaatcgctcctgcatttgacatctggggccagggaaacctggtcaccgtctcctcagcctccaccaagggcccatcggtcttcccctggcaccctcctccaagagcacctctgggggcacagcgccctgggctgcctggtcaaggactacttcctctctcgact

SEQ ID NO: 461951 - DNA, 514 bp, Homo sapiens
  misc_feature: HEFZJCU01CQX0U.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggccatcggtcttcccctggcgcctgctccaggagcacctccgagagcacagcggccctgggctcgg

SEQ ID NO: 461952 - DNA, 508 bp, Homo sapiens
  misc_feature: HEFZJCU01CF0L2.3.71.G05.1.454.heavy.3.raw
  modified_base (185)..(185): a, c, t, g, unknown or other
agacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggattttccttttggctattttaaaaggtgtccggtntgaagtgcaactggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtgataacatcggctatgcggactctgtgaagggccgattcaccatctccagagacaacgccaagaactccctgtatctgcaaatgaacagtctgagacctgaggacacggccttgtattactgtgtaaagtccgggaatatgtacgtattttggactt

SEQ ID NO: 461953 - DNA, 516 bp, Homo sapiens
  misc_feature: HEFZJCU01BZVGV.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccaaggga

SEQ ID NO: 461954 - DNA, 497 bp, Homo sapiens
  misc_feature: HEFZJCU01BNA0Z.10.21.B10.1.454.heavy.3.raw
catagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacggactggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatcctaagtggcta

SEQ ID NO: 461955 - DNA, 536 bp, Homo sapiens
  misc_feature: HEFZJCU01COV6O.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcctttttactacctcccttcgtactttctgggggccatcggaaccccggtccg

SEQ ID NO: 461956 - DNA, 519 bp, Homo sapiens; identical to SEQ ID NO: 444867
  misc_feature: HEFZJCU01CR50P.9.34.D01.1.454.heavy.3.raw

SEQ ID NO: 461957 - DNA, 495 bp, Homo sapiens
  misc_feature: HEFZJCU01EM76J.51.1.A01.1.454.heavy.3.raw
cgatcgtatacacgaccggtgctcgatttagacgtctcatcagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcatatgatggaagtaatatatactatgtagactccgtgaagggccgattcatcatctccagagacaattccgagaacacgctgtatctgcaaatgaacagcctgagagttgaggacacggctgtgtattattgtgcgaacttaatcacggaggacaacggtaccg

SEQ ID NO: 461958 - DNA, 507 bp, Homo sapiens
  misc_feature: HEFZJCU01D0HRW.48.44.D11.1.454.heavy.3.raw
agtatacatacacgaccggtgctcgatttagcgcagtacgaaggggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggtgccctgctccaggagcacctccgagagcacagcggccctgggctgcctggtcaaggactacttcctatgtatact

SEQ ID NO: 461959 - DNA, 514 bp, Homo sapiens
  misc_feature: HEFZJCU01DV6F7.48.70.G04.1.454.heavy.3.raw
agtatacatacacgaccggtgctcgatttagtgtagtgtgaagggaaagggggctctgggagaggagccccagccctgagattcccaggtgtttccattcagtgatcagcactgaacacagaggactcaccatggagttgggactgaactggattttccttttggctattttaaaaggtgtccagtgtgaactgcaactggtggagtctgggggaggcttggtacagcctggcaggtccctgagactctcctgtgcagcctctggattcacctttggtgattatgccatgcactgggtccggcaagctccagggaagggcctggagtgggtctcaggtattagttggaatagtgatagcataggctatgcggactctgtgaagggccgattcaccatctccagagacaacgccaagaactccctgtatctgcaaatgaacagtctgagaactgaggacacggccttgtattactgtgtaaaagataatgatttttggggttcggggagtttgga

SEQ ID NO: 461960 - DNA, 519 bp, Homo sapiens; identical to SEQ ID NO: 445330
  misc_feature: HEFZJCU01D5TN7.7.78.H01.1.454.heavy.3.raw

SEQ ID NO: 461961 - DNA, 508 bp, Homo sapiens
  misc_feature: HEFZJCU01CMLIO.51.30.C08.1.454.heavy.3.raw
cgatcgtatacacgaccggtgctcgatttagtctgacgtcaaagggaaaggggaggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagttgctgggaaggacatactacaggtccaagtggtttaatgattatgcagtatctgtgaaaagtcgaataaccatcaacccagacacatccaagaaccagttctccctgcaactgaactctgtgactcccgaggacacggccgtgtattactgtgcaagaggttggttaacagctggaggatttgactactggggccagggaaccctggtcaccgtctcctcagcctccaccaagggcccatcggtcttcccctggcgccctgctccaggagcacctccgagagcacagcggccctggg

SEQ ID NO: 461962 - DNA, 520 bp, Homo sapiens
  misc_feature: HEFZJCU01BNHQR.13.55.E11.1.454.heavy.3.raw
tcacgtactacacgaccggtgctcgatttagcactcgcacgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacggcaaatatggttcagggagttcgactactggggccagggaaccctggtcaccgtctcctcagcctccaccaggg

SEQ ID NO: 461963 - DNA, 530 bp, Homo sapiens; identical to SEQ ID NO: 456319
  misc_feature: HEFZJCU01CAAGD.18.33.C11.1.454.heavy.3.raw

SEQ ID NO: 461964 - DNA, 522 bp, Homo sapiens; identical to SEQ ID NO: 451196
  misc_feature: HEFZJCU01AM8D5.10.79.H02.1.454.heavy.3.raw

SEQ ID NO: 461965 - DNA, 530 bp, Homo sapiens
  misc_feature: HEFZJCU01CS2QS.12.12.B01.1.454.heavy.3.raw
atacgacgtacacgaccggtgctcgatttagtagtgtagattccgcgggggctttctgagagtcatggacctcctgtgcaggaacatgaagcacctgtggtttttcctcctgctggtggcagctcccagatggggcctgtcccaggtgcagctgcaggagtcgggcccaggactggtgaagccttcggagaccctgtccctcacctgcgctgtgtccggtttctccatcagtagtgggcattattggggctggatccggcagcccccagggaaggggctggagtggattgggagtatctattttagcgggagcacctaccagaacgcgtccctcaagagtcgaatcaccatgtcggtggacacatcgaagaaccagatctcccttaagttgaggtctgtgaccgccgctgacacggccgtctattactgtgcgagagtccgtgctggaagaacacttttttgactattggggccagggaatcctggtcaccgtcgcctcagccctccaccagggcccatcggtcttcccc

SEQ ID NO: 461966 - DNA, 523 bp, Homo sapiens
  misc_feature: HEFZJCU01CZXZU.13.33.C11.1.454.heavy.3.raw
tcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattggggatatctcttatagtgggagtacgaactacaatccgtccctcaagagtcgagtcatcatatccgtagacaggtccagggaacgaattctccctgaaagtgagttctgtgaccgtcgcagacacggctgtctattattgtgcgagacggcaaatatggttcaggggagtttcgactactggggccgagggaacccgtggtccaccgtctcctcacgcctccacc

SEQ ID NO: 461967 - DNA, 395 bp, Homo sapiens
  misc_feature: HEFZJCU01BCCPC.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttctacgtgagct

SEQ ID NO: 461968 - DNA, 505 bp, Homo sapiens; identical to SEQ ID NO: 451682
  misc_feature: HEFZJCU01ES6GF.10.38.D05.1.454.heavy.3.raw

SEQ ID NO: 461969 - DNA, 528 bp, Homo sapiens
  misc_feature: HEFZJCU01DECSS.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactactgggggttcgaccccgtggggccagggaaccctgggtcaccgtctcctcagcctccaccg

SEQ ID NO: 461970 - DNA, 520 bp, Homo sapiens
  misc_feature: HEFZJCU01BR7TZ.13.59.F04.1.454.heavy.3.raw
tcacgtactacacgaccggtgctcgatttagtacacacacttagggattggggggaagaggaagactgacggtcctgccacaggtggtgctgggcacggtggaatcctgctccccaccatggacatactttgttccacgctcctgctactgactgtcccgtcctgggtcttgtcccaggtcaccttgagggagtctggtcctgcgctggtaaaacccaaacaggccctcacagtgacctgcaccgtctctgggctttcactcaatagaagtacagtgtgtatgagttggattcgtcagtccccagggaaggccctggagtggcttgcacgcattgattgggatgatgatcaaaaatattacaacacatctatgaagaccaggctcaccatctccaaggacatcttcacgagccaagtggtccttagaatgaccaacttggaccctgtggacacaggcacctattattgtgcacatcaaagagatttctactacggtgtggacgtctgggggccaaggggg

SEQ ID NO: 461971 - DNA, 532 bp, Homo sapiens
  misc_feature: HEFZJCU01CNWZN.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttggaggggcctttcatgtctggggccaagggacgctggtcaccgtctcttcagcctccaccaagggcccatcggtcttccccctggccaccctcctccaagagcacctctgggggc

SEQ ID NO: 461972 - DNA, 495 bp, Homo sapiens
  misc_feature: HEFZJCU01D6Y9Y.51.83.H06.1.454.heavy.3.raw
cgatcgtatacacgaccggtgctcgatttagatcacgtgcgtcgcggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggactctgggggaggcgtggtccagcctgggaggtccctgcgactctcctgtgcagcctctggattcagcttcagggctaatactatgttctgggtgcgccaggctccaggcaaggggctggagtgggtggcagtcatctggcctgatggaggtttaacatactatgcggactccgtggagggccgattcaccgtctccagagacaactccaaaaacacgctgtatctccaaatgaacagcctcagatctgaggacacggctatctactactgtgtgaagaattgggtttcagtgg

SEQ ID NO: 461973 - DNA, 496 bp, Homo sapiens
  misc_feature: HEFZJCU01CPXF1.51.47.E03.1.454.heavy.3.raw
cgatcgtatacacgaccggtgctcgatttagactcgcgcacagagagaagggggactcctgtgccccaccatggacacactttgctccacgctcctgctgctgaccatcccttcatgcgtcttgtcccagatcaccttgaaggagtctggtcctacgctggtgaagcccacacagaccctcacgctgacctgcaccttctctgggttctcactctccagtcctggagtggctgtgggctggatccgtcagcccccaggaaaggccctggagtggctggcactcatttattggaatgacgataagacctacagcccatttctgaagaacaggctcaccatcaccaaggacacctccaagaaccaggtgctccttagactgaccaacatggaccctgtggacacagccacatattactgtgtacacgtcccccgccgtattattatgatgctagtggttattccaacgctgaatacttccagcactggggccagggca

SEQ ID NO: 461974 - DNA, 496 bp, Homo sapiens
  misc_feature: HEFZJCU01AKYTM.52.35.D02.1.454.heavy.3.raw
cgcagtacgacacgaccggtgctcgatttagcacacgatagttgggtttgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttctggggccagggaacccgggtcaccgtctcctcagcctccaccaagggcccatcggtcttccccctcggcaccctcctccaagagcacctctgggggcacagcggccctgggctgcctggtcaaggactacttcctatacgatcg

SEQ ID NO: 461975 - DNA, 545 bp, Homo sapiens
  misc_feature: HEFZJCU01B2TC6.49.33.C11.1.454.heavy.3.raw
agtcgagagacacgaccggtgctcgatttagagtgagctcgttgggtttggggctttttcttgtggctactttaaaaggtgtccagtgtgacgtccaactggtggagtctgggggaggcttggtgcagcctggggggtccctgagactctcctgtgtagcctctgagttcacctttagagtctatgccatgagttgggtccgccaggctccagggaaggggctggagtgggtctcaggtatcagtggtaatgatggtaacacaaactatgcagactccgtgaagggccggttcaccatctccagagacaattccaagaatatgctatttctgcaaatgaacagcctgagaatcgaggacacggccgtatattactgtgtgaaagaagatggaccgctggacgaggagccctacggcgggtcctactttgactactggggccggggaacccgtggtcaccgtctcctcacgcctccaccaagggcccatcggtccttcccctggcaccctcctccaagagcacctcgtgggggcacagcggccgtc

SEQ ID NO: 461976 - DNA, 507 bp, Homo sapiens
  misc_feature: HEFZJCU01DM7T8.9.64.F09.1.454.heavy.3.raw
tgatacgtctcacgaccggtgctcgatttagcgcgtatacaaggggctcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagcctggggggtccctgagactctcctgtgcagcctctggattcacctttagtcactattggatgagttgggtccgccaggctccagggaagggcctggagtgggtggccaacataaaggaagatggaagtgagaagtcctatgtggactctgtgaagggccgattcatcatctccagagacaacgccgagaactccctgtatctgcaaatgaacagcctgagagtcgaggacacggctatgtattattgtgtgagagataaaagtgggccagggaaccctggtcaccgtct

SEQ ID NO: 461977 - DNA, 519 bp, Homo sapiens
  misc_feature: HEFZJCU01CYAJP.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccaggggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaagggacaatggtcaccggtctcttcagcctccaccaagggcccatcggtcttccccctggccaccctcctccaagagcacctctgggggcacagcggcccg

SEQ ID NO: 461978 - DNA, 498 bp, Homo sapiens; identical to SEQ ID NO: 458054
  misc_feature: HEFZJCU01EEQT0.13.33.C11.1.454.heavy.3.raw

SEQ ID NO: 461979 - DNA, 508 bp, Homo sapiens
  misc_feature: HEFZJCU01B92F7.13.37.D04.1.454.heavy.3.raw
tcacgtactacacgaccggtgctcgatttagtagcatactgttgggtttgggggaggcttcggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattgtaatgatggtagctgctactacactttttgactactggggccagggaaccctggtcaccgtctcttcagcctccaccaagggcccatcggtcttccccctggcaccctcctccaagagcacctctgggggcacagcggccctgggctgcctggtcaaggactacttcctagtacgtga

SEQ ID NO: 461980 - DNA, 497 bp, Homo sapiens; identical to SEQ ID NO: 458817
  misc_feature: HEFZJCU01CYYDB.53.4.A04.1.454.heavy.3.raw

SEQ ID NO: 461981 - DNA, 500 bp, Homo sapiens; identical to SEQ ID NO: 446033
  misc_feature: HEFZJCU01DA3U1.11.27.C05.1.454.heavy.3.raw

SEQ ID NO: 461982 - DNA, 499 bp, Homo sapiens; identical to SEQ ID NO: 447461
  misc_feature: HEFZJCU01ERND8.3.20.B09.1.454.heavy.3.raw

SEQ ID NO: 461983 - DNA, 404 bp, Homo sapiens
  misc_feature: HEFZJCU01BCHFT.15.28.C06.1.454.heavy.3.raw
tctacgtagccacgaccggtgctcgatttagagctcacgtattgggtttggggggaagaggaagactgacggtcctgccacaggtggtgctggagtgggtggccaccatacaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttggggccagggaaccctggtcaccgtctcctcagcctccaccaagggcccatcggtcttccccctgcgccctgctccaggagcacctccgagagcacagcggccctgggctgcctggtcaaggactacttccgctacgtaga

SEQ ID NO: 461984 - DNA, 506 bp, Homo sapiens; identical to SEQ ID NO: 452514
  misc_feature: HEFZJCU01CLL9U.51.56.F01.1.454.heavy.3.raw

SEQ ID NO: 461985 - DNA, 526 bp, Homo sapiens
  misc_feature: HEFZJCU01AO1LL.18.59.F04.1.454.heavy.3.raw
  modified_base (470)..(470): a, c, t, g, unknown or other
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttaggactcccctgtacagcctctggattcactttcagtaaggcctggatgaactgggtccgccaggctccagggaagggctggagtgggttggccgtattaaaaccaaactgatggtgggacaacagactacgctgcacccgtgaaaggcagattcaccatctcaagagatgattacaaaagcacgctgtatctgcaaatgaacagcctgagaaccgaggacacagccgtntattactgtaccacactcccagaagcgtacaactactactactacggtatggacct

SEQ ID NO: 461986 - DNA, 508 bp, Homo sapiens
  misc_feature: HEFZJCU01EB99U.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcagggtattagtggtagtggtggtagcagatactacgcagactccgtgaagggccggttcagcgatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtctcccctggcaccctcctccaagagcacctctggggcacagcggccctggctgcctggtcaaggactacttcctacgtcgtat

SEQ ID NO: 461987 - DNA, 487 bp, Homo sapiens
  misc_feature: HEFZJCU01EI9VX.47.85.H08.1.454.heavy.3.raw
agctcacgtacacgaccggtgctcgatttagtatcactcagtcgggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctccgagagcacagcggcctgggctgcctggtcaaggactacttcctacgtgagct

SEQ ID NO: 461988 - DNA, 383 bp, Homo sapiens
  misc_feature: HEFZJCU01AQNWN.3.29.C07.1.454.heavy.3.raw
agacgcactccacgaccggtgctcgatttagagtgctacgaagggaagggcctggagtgggtctcaggtattggattggacaatgataggacaggctatgcggactctgtgaagggccgattcaccgtctccgtggacaaggccaggaggtccatgtttctgcaaatgaacagtctgagagctgacgacacggccctctatttttgtggaaaagacatgacaccggggggtcttgactattggggccagggaatccgggtcaccgtctcctcagcctccaccaagggcccatcggtcttccccctggcgccctgctccaggagcacctccgagagcacagcggccctgggctgcctggtcaaggactacttccgagtgcgtct

SEQ ID NO: 461989 - DNA, 538 bp, Homo sapiens
  misc_feature: HEFZJCU01D46SA.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccggggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaagatacgaagtctatgatacccaatttgggagggcctttcatgtctggggccaagggacgctggtcaccgtctcttcagcctccaccaagggcccatcggtccttcccctggccaccctcctccaagagcacctctgggggcacagcc

SEQ ID NO: 461990 - DNA, 502 bp, Homo sapiens; identical to SEQ ID NO: 450016
  misc_feature: HEFZJCU01DS5RP.17.10.A10.1.454.heavy.3.raw

SEQ ID NO: 461991 - DNA, 501 bp, Homo sapiens; identical to SEQ ID NO: 449393
  misc_feature: HEFZJCU01DJN1X.17.10.A10.1.454.heavy.3.raw
  modified_base (460)..(460): a, c, t, g, unknown or other

SEQ ID NO: 461992 - DNA, 514 bp, Homo sapiens
  misc_feature: HEFZJCU01AZVSM.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctgggtctccgtcagcagcgactgtattgcctgggtccgccaggctccagggaagaggccggagtgggtcgcaggtatttttataggtgggacgacattctacggagacgtccatggagggccgattcaccatctccagagactttctcagacacactgtctcttcaaatgaacagcctgagggccgaggacacggccgtctattattgtgtgagagttttatggcgatggctttgtggacagatcactgggggccaa

SEQ ID NO: 461993 - DNA, 500 bp, Homo sapiens; identical to SEQ ID NO: 446033
  misc_feature: HEFZJCU01EQ8FR.11.27.C05.1.454.heavy.3.raw

SEQ ID NO: 461994 - DNA, 491 bp, Homo sapiens
  misc_feature: HEFZJCU01CE1HU.11.13.B02.1.454.heavy.3.raw
  modified_base (204)..(204): a, c, t, g, unknown or other
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacngtatgtagactctgtggagggccggttcaccatctccagagacaacgccaagaatgcgatatatctacagatgaacagcctgcgagccgaggacacggctgtgtattactgtaggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctggtcaaggactacttccgtatctctcg

SEQ ID NO: 461995 - DNA, 515 bp, Homo sapiens
  misc_feature: HEFZJCU01C5MV7.26.71.G05.1.454.heavy.3.raw
agactatactcacgaccggtgctcgatttagtgtcgtcgcaagagagaggggggggaagaggaagactgacggtcctgcgctggtggagcccacgcagaccctcacgctgacctgctccgtctctggattctcactcaccacgactgaggtgaatgtggcctgggtccgtcaggcccccggaaaggccctggagtggcttgcactcatttactggagtgatctcaagcggtacaatccgtctctgaggaatcgactcaccatcaccagggacacctccaaagaccgggtggtccttacaatgaccgacatgaatcctgtggacacaggcacatattactgtgcacacagtcctagcggctacgcgagaaaagaatatgactattgggccagggaatttggtcaccgtctccccagcctccaccaagggcccatcggtcttcccctcggcgccctgctccaggagcaccctccgagagcacagcggccctgggctgcctggtcaaggactacttcc

SEQ ID NO: 461996 - DNA, 519 bp, Homo sapiens
  misc_feature: HEFZJCU01AYJPM.13.76.G10.1.454.heavy.3.raw
tcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatcctccagagacaattccaagaacacgctgtttcttcaaatgaacagcctgagagccgatgacacggccgtgtattactgtgcgagagagtggggcccacgaacgttactacgctatggacgtctggggccaagggaccg

SEQ ID NO: 461997 - DNA, 522 bp, Homo sapiens; identical to SEQ ID NO: 455974
  misc_feature: HEFZJCU01DHQOH.12.40.D07.1.454.heavy.3.raw

SEQ ID NO: 461998 - DNA, 497 bp, Homo sapiens; identical to SEQ ID NO: 447711
  misc_feature: HEFZJCU01B8SUK.16.37.D04.1.454.heavy.3.raw

SEQ ID NO: 461999 - DNA, 523 bp, Homo sapiens
  misc_feature: HEFZJCU01D93NJ.48.66.F11.1.454.heavy.3.raw
agtatacatacacgaccggtgctcgatttagtcacgcgagaagggggagccccagccctgggattcccagctgtttctgcttgctgatcaggactgcacacagagaactcaccatggagtttgggctgagctgggttttccttgttgctattttaaaaggtatccagtgtgaggagcagctggtggagtccggcggaggcttagttcagccgggggggtccctgagactctcctgtgtggcctctggattcacaattaatccatattggatcctctgggtccgccaagttccagggaagggctggtttgggtctcacgtatttatgctgctggagatacagcctacgcggactccgtgaagggccgattcaccatctctagagacaacgccaagaacacggtgactctgcaaatggacggtctgagggccgacgacacggctgtctactattgtgcaaaagggccgattaactcttacggtctggacgtctggggccaagggccacggtcagcgtctcttcag

SEQ ID NO: 462000 - DNA, 469 bp, Homo sapiens; identical to SEQ ID NO: 445536
  misc_feature: HEFZJCU01EXNDX.48.51.E07.1.454.heavy.3.raw

SEQ ID NO: 462001 - DNA, 501 bp, Homo sapiens
  misc_feature: HEFZJCU01DR6GX.10.38.D05.1.454.heavy.3.raw
  modified_base (479)..(479): a, c, t, g, unknown or other
  modified_base (481)..(481): a, c, t, g, unknown or other
catagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgaacntnactacgctcaattctgggcc

SEQ ID NO: 462002 - DNA, 488 bp, Homo sapiens
  misc_feature: HEFZJCU01DO62S.40.85.H08.1.454.heavy.3.raw
tctagcgactcacgaccggtgctcgatttagtatcactcagtcgcggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccactggggccagggaaccctggtcaccgtctcctcagcctccaccaagggcccatcggtcttcccctggcgccctgctccaggagcacctccgagagcacagcggccctgggctgctggtcaaggactacttcagtcgctaga

SEQ ID NO: 462003 - DNA, 526 bp, Homo sapiens; identical to SEQ ID NO: 445530
  misc_feature: HEFZJCU01B4N52.12.86.H09.1.454.heavy.3.raw

SEQ ID NO: 462004 - DNA, 530 bp, Homo sapiens
  misc_feature: HEFZJCU01A1B10.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggccagggaaccctggtgaccgtctcctcagcctccaccaacgggcccatcggtcttcccctggcgccctgctccaggagcacctccgacgagcacagcggccccgtgggccg

SEQ ID NO: 462005 - DNA, 520 bp, Homo sapiens
  misc_feature: HEFZJCU01ERQ6C.11.25.C03.1.454.heavy.3.raw
cgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtcgtggggccaaggg

SEQ ID NO: 462006 - DNA, 507 bp, Homo sapiens
  misc_feature: HEFZJCU01CZU1S.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaagtgacgtggtagttccggggggacgacatgacaccg

SEQ ID NO: 462007 - DNA, 523 bp, Homo sapiens
  misc_feature: HEFZJCU01D18ZI.12.33.C11.1.454.heavy.3.raw
atacgacgtacacgaccggtgctcgatttagagtgagctcgttgggtttggggggaagaggaagactgacggtccccccaggagttcaggtgctgggcacggtgggcatgtgtgagttttgtcacaagatttgggctcaactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctgggccaagggaccacggtcatcgtctcctcagcctccaccaagggcccatcggtcttcccctggccaccctcctccaagagcacctctgggggcacagcc

SEQ ID NO: 462008 - DNA, 514 bp, Homo sapiens
  misc_feature: HEFZJCU01DHVTC.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggccatcggtcttcccctggcgcctgctccaggagcacctccgagagcacagcggcccgtcggctcg

SEQ ID NO: 462009 - DNA, 504 bp, Homo sapiens
  misc_feature: HEFZJCU01CXGW0.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcaacccatactaactttgactac

SEQ ID NO: 462010 - DNA, 403 bp, Homo sapiens
  misc_feature: HEFZJCU01A4XX4.16.72.G06.1.454.heavy.3.raw
tgtactactccacgaccggtgctcgatttagctacgactgcaagggaaaggggctggagtgggtctcatctattagtagtagtgatagtgccacatactacgcagactccgtgaagggccggttcaccatctccagagatagatccaagaacacgctgtatctgcaaatggacagcctgagagccgaggacacggccatatattactgtgcgaaagatctggggaatgactacgatggtaccaacgtccgcttggactcctggggccagggagccctggtcaccgtctcctcagcctccaccaagggcccatcggtcttcccctggcgccctgctccaggagcacctccgagagcacagcggccctgggctgcctggtcaaggactacttccgagtacgtaca

SEQ ID NO: 462011 - DNA, 518 bp, Homo sapiens
  misc_feature: HEFZJCU01EQB0S.10.9.A09.1.454.heavy.3.raw
catagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaaggaggggggaaccaggcggggagttccaagtactacctttgaccgtcgt

SEQ ID NO: 462012 - DNA, 505 bp, Homo sapiens; identical to SEQ ID NO: 452912
  misc_feature: HEFZJCU01ENMPH.16.34.D01.1.454.heavy.3.raw

SEQ ID NO: 462013 - DNA, 538 bp, Homo sapiens
  misc_feature: HEFZJCU01CYMB8.18.59.F04.1.454.heavy.3.raw
tacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaccaaactgatggtgggacacagactacgctgcacccgtgaaaggcagattcaccatctcaagagatgattcaaaaagcacgctgtatctgcaaatgaacagcctgagaaccgaggacacagccgtgtattactgtaccacatcccctgaaagcgtcaactactactactacggtatggacctcgtggggccaagggga

SEQ ID NO: 462014 - DNA, 504 bp, Homo sapiens
  misc_feature: HEFZJCU01D9AVV.51.65.F10.1.454.heavy.3.raw
cgatcgtatacacgaccggtgctcgatttagctacgctctaagggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggattaattccaaaagtggtggcacaaagactgcacagaagtttcagggcagggtcaccatgaccagggacaagtccaccaacacagcctacatggaactaagggactgacatctgacgacacggccatgtattattgtgcgagagaaatgttaggtactgctttgggtcctggggcccgggaaccgggtc

SEQ ID NO: 462015 - DNA, 513 bp, Homo sapiens
  misc_feature: HEFZJCU01EB5YL.11.13.B02.1.454.heavy.3.raw
cgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttccccctggcgccctgctccaggagcacctccgagagcacagcggccctggg

SEQ ID NO: 462016 - DNA, 524 bp, Homo sapiens
  misc_feature: HEFZJCU01CZ0KP.53.41.D08.1.454.heavy.3.raw
cgcgtatacacacgaccggtgctcgatttagtcacgcgagaaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctggattcaccttcagggtctatgacatgcactgggtccgccaggctccaggcaaggggctggagtgggtggcagttattcaaatgatggaagtaacaaatactatgtggactccgtgaagggccgattcaccatctccagagacaattccaagaatacgctgtatctgcacatgaacagcctgagagccgaagacacgggtgtttattactgtgcgaacttaattacggaggacaacggtaaccccgtccgcgacggtacggacg

SEQ ID NO: 462017 - DNA, 470 bp, Homo sapiens; identical to SEQ ID NO: 444866
  misc_feature: HEFZJCU01EUXGW.4.36.D03.1.454.heavy.3.raw

SEQ ID NO: 462018 - DNA, 518 bp, Homo sapiens
  misc_feature: HEFZJCU01A44JL.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaactttttagtggtagtggtggtcacgcctactacgcagagtccgtgaagggccgattcaccatctccagagacacttccgagaacacgctgtatctgcgaatgaacagcctgagagtcgaggacacggccatatatttactgtgcgaaagatcctgaggcctataccacctcagtcagctggttcgaccctggggccagggaaccctggtcaccgtctcctcagcctccaccaagggcccatcggtcttcccctggcaccctcctccaagagcacctctggggcacagcggcctgggctgcctggtcaaggactacttccgagtagtacac

SEQ ID NO: 462019 - DNA, 449 bp, Homo sapiens
  misc_feature: HEFZJCU01ERVFZ.53.35.D02.1.454.heavy.3.raw
cgcgtatacacacgaccggtgctcgatttagcacacgatagttgggtttgggctcggggctgccctttggctttggagatggttttctcgatgggggctggagtgggtggcagttatatcaaatgatggaagtaagaaatactatgtagactccgtgaagggccgattcaccatctccagagacaattccaagaatacgctgtatctgcacatgaacagcctgagagccgaagacacgggtgtttattactgtgcgaacttaattacggaggacaacggtaacccccgtccgcacggtacggacgtctggggccaagggaccacggtcaccgtctcctcagcctccaccaagggcccatcggtcttccccctggcaccctcctccaagagcacctctgggggcacagcggccctgggctgcctggtcaggactacttcctcgtactgcg

SEQ ID NO: 462020 - DNA, 526 bp, Homo sapiens
  misc_feature: HEFZJCU01B7QD6.12.58.F03.1.454.heavy.3.raw
  modified_base (522)..(522): a, c, t, g, unknown or other
atacgacgtacacgaccggtgctcgatttagtctgatcgagaagggaaaggggcagagaggagccttagccctggactccaaggcctttccacttggtgatcagcactgagcacagaggactcaccatggaattgggggctgagcgtggttttccgttgttaggctatttagaaggtgtccagtgtgagggacaattggtggagtctggggaggcttggtccagccgggggggtccctgagactctcctgtacagcctctggattcactctcggaaacttttggatggtctgggtccgccaggctccagggaaggggctggagtgggtggccaatatacagtcaggtggaggtacgatacactatctcgactctgtgaagggccggttcaccatctccagagacaacgccaagaattcactgtatctgcaaatgaacagcctgagagtcgaagacacgggtatttattattgtgtgcgagatctggatttccttgaaatgaagtgtggttcgatgtgtttgnttcg

SEQ ID NO: 462021 - DNA, 506 bp, Homo sapiens
  misc_feature: HEFZJCU01EOKQF.17.78.H01.1.454.heavy.3.raw
cgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagcctggggcctcagtgaaggtttcctgcaaggcttctggatacaccttcacgacgtatgctattcactgggtacgccaggcccccggacacagccttgagtggatgggatggatgaacgttgacaatgggaatacgagatattcacagaaattccagggcagagtcaccattaccagggacacatccgcgaacacagcctacatggagctgacgggcctgacatctgaagacacggctttatattactgtgcgcgagatggctggcacagagggcacaactggcctcgaccccgg

SEQ ID NO: 462022 - DNA, 489 bp, Homo sapiens
  misc_feature: HEFZJCU01A8JB2.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcagcctccaccaagggcccatcggtcttcccctggcgccctgctccaggagcacctccgagagcacagcggccctgggctgcctggtcaaggactacttcccatactcgta

SEQ ID NO: 462023 - DNA, 510 bp, Homo sapiens
  misc_feature: HEFZJCU01AJMRT.12.55.E11.1.454.heavy.3.raw
atacgacgtacacgaccggtgctcgatttagcactcgcacgttgggtttgggctgagctgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaaggcccatcggtcttcccctggcgcctgctcaggagcacctcg

SEQ ID NO: 462024 - DNA, 416 bp, Homo sapiens
  misc_feature: HEFZJCU01EE1QT.14.74.G08.1.454.heavy.3.raw
cgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaatggtcaccgtctcttcagcctccaccaagggcccatcggtcttccccctggcaccctcctccaagagcacctctgggggcacagcggccctgggctgcctggtcaaggactacttccgtactagacg

SEQ ID NO: 462025 - DNA, 396 bp, Homo sapiens; identical to SEQ ID NO: 444731
  misc_feature: HEFZJCU01ENLL1.18.61.F06.1.454.heavy.3.raw

SEQ ID NO: 462026 - DNA, 537 bp, Homo sapiens
  misc_feature: HEFZJCU01C5MMH.17.28.C06.1.454.heavy.3.raw
  modified_base (505)..(505): a, c, t, g, unknown or other
  modified_base (523)..(523): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaatggctgtntttattggggccaggganccctggtcctaccg

SEQ ID NO: 462027 - DNA, 500 bp, Homo sapiens; identical to SEQ ID NO: 454990
  misc_feature: HEFZJCU01CX3I1.11.71.G05.1.454.heavy.3.raw

SEQ ID NO: 462028 - DNA, 464 bp, Homo sapiens; identical to SEQ ID NO: 445533
  misc_feature: HEFZJCU01C00G8.19.10.A10.1.454.heavy.3.raw

SEQ ID NO: 462029 - DNA, 518 bp, Homo sapiens
  misc_feature: HEFZJCU01BK6OK.15.16.B05.1.454.heavy.3.raw
tctacgtagccacgaccggtgctcgatttagagctcacgtattgggtttgaggtctcagagaggagccttagccctggactccaaggcctttccacttggtgatcagcactgagcacagaggactcaccatggaattggggctgagcgtggttttcgtgttaggctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttggggccagggaaccctggtcaccg

SEQ ID NO: 462030 - DNA, 480 bp, Homo sapiens
  misc_feature: HEFZJCU01BY1ZR.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcaggggtcaccatgaccagggacacgtccatcagcacgtccatcagcacagcctacatggacctgagcggcctgacatctgacgacacggccgtatatttctgtgcgaggg

SEQ ID NO: 462031 - DNA, 526 bp, Homo sapiens; identical to SEQ ID NO: 446878
  misc_feature: HEFZJCU01DSLMJ.18.33.C11.1.454.heavy.3.raw

SEQ ID NO: 462032 - DNA, 528 bp, Homo sapiens
  misc_feature: HEFZJCU01BDARL.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcgggggaccttcgaccctggttctacttcgatctctgggggccgt

SEQ ID NO: 462033 - DNA, 497 bp, Homo sapiens; identical to SEQ ID NO: 445179
  misc_feature: HEFZJCU01BRLSZ.12.55.E11.1.454.heavy.3.raw

SEQ ID NO: 462034 - DNA, 526 bp, Homo sapiens
  misc_feature: HEFZJCU01CLM48.53.64.F09.1.454.heavy.3.raw
cgcgtatacacacgaccggtgctcgatttagcgcgtatacaagggggagagaggagcccagccctgggattttcaggtgttttcatgtggtgatcaggactgaacagagagaactcaccatggagtctgggctgacgtggctttttcttgtggctattttaaaaggtgtccagtgcgacgtgcagctggtggagtcgggggaggcttggtacagccgggggggtccctgagactctcctgtagagtctctggcttcacctttggagtctatgacatgagttgggtccgccaggctccggggaaggggctggagtgggtctcaacgatcagtgatagcggaagtaccacaaactacgccgcctccgtgaagggccgatgcaccgtctccagagacaattcgaaggacactttatatctgcaactcaacagactgacaaccgctgacacggccgtctattactgtgtcaaagaagacggaccgactggacgaggaggccagaggaaaagtacactaactttgtactac

SEQ ID NO: 462035 - DNA, 498 bp, Homo sapiens
  misc_feature: HEFZJCU01CVSJ3.51.23.C01.1.454.heavy.3.raw
cgatcgtatacacgaccggtgctcgatttagtacacgtgattagggattgggggcatcacataacaaccagattcctcctctaaagaagcccctgggagcacagctcatcaccatggactggacctggaggttcctctttgtggtggcagcagttacaggtgtccattcccaggtccagctggtgcagtctggggctgaggtgaagatgcctgggtcctcggtgaaggtctcctgcaagtattctggaggcaccttcagcaactatggtatcagctgggtgcgacaggcccctggacaagggcttgagtggatgggaagggtcaccctatatttgatgtagcagactctgcacagaagttccagggcagaataacaattacggcggacaaatccacgaccacagcctacatggagctgagcagcctgagatctgaggacacggccctttattactgtgcgagatttaccggtggggtcacggcggatatatcgccata

SEQ ID NO: 462036 - DNA, 527 bp, Homo sapiens
  misc_feature: HEFZJCU01A45RX.18.33.C11.1.454.heavy.3.raw
tacgagtatgcacgaccggtgctcgatttagagtgagctcgttgggttttccttgttgctatttcaaaaggtgtccactgtgaggagcagttggtggagactggaggaagcctgatccagccgggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccaccctccaccaagggcccatcggtcttccccctggcaccctcctccaagagcacctctgggggcacagcggccctgggctgcctggtcaaggactacttcccatactcgta

SEQ ID NO: 462037 - DNA, 501 bp, Homo sapiens
  misc_feature: HEFZJCU01CI7QA.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatcggtctttcccctggcgccctgct

SEQ ID NO: 462038 - DNA, 480 bp, Homo sapiens
  misc_feature: HEFZJCU01DFLME.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctgcaccctcctccaagagcacctctggggcacagcggccctgggctgcctggtcaaggactacttcctagagacacg

SEQ ID NO: 462039 - DNA, 392 bp, Homo sapiens
  misc_feature: HEFZJCU01EUQ9Z.49.73.G07.1.454.heavy.3.raw
agtcgagagacacgaccggtgctcgatttagctctacgctcagggcacgaccggtgctcgatttagtcgatagtgaagggaaaggggttccagggcagagtcaccatcaccagggacacatccgcgagcacagcctacatggaactgagcagcctgagatctgaagacacgggtgtatattactgtgcgagagggaagtgggatattgtagatgcgccaggtgcccggccggccccctactttgactactggggccggggaaccctggtcaccgtctcctcagcctccaccaagggcccatcggtcttccccctggcaccctcctccaagagcacctctgggggcacagcggccctgggctgcctggtcaaggactacttcctctctcgact

SEQ ID NO: 462040 - DNA, 468 bp, Homo sapiens
  misc_feature: HEFZJCU01BI8H0.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggcccatcggtcttcccctggcgcctgctccaggagcacctccgagagcacagcggccctgggctgcctggtcaggactacttccctacagtgct

SEQ ID NO: 462041 - DNA, 539 bp, Homo sapiens
  misc_feature: HEFZJCU01D974P.48.43.D10.1.454.heavy.3.raw
agtatacatacacgaccggtgctcgatttagactagcagtaagggggctttctgagagtcatggacctcctgcacaagaacatgaaacacctgtggttcttcctcctcctggtggcagctcccagatgggtcctgtcccaggtacagctacaacagtggggcgcaggacatttgaagccttcggagacgctgtccctcacctgcgctgtgtatggtgggtccttcaggggttacttctggacctggatccgccagcccccagggaaggggctggagtggattggggaggtcaggcatagtgccagggccacttacaacccgtccctcaacgatcgagtctccatcttagttgacacgtccaagaaccagttctcccttcaactcacgtctgtgaccgccgcggacacggctatatactactgtgcgagagggtcctggctctctccgcctttgacgcctggggccagggaaaactggtcaccgtctcctcagcttccaccaagggcccatcggtccttcccctcggcgccctcgctccg

SEQ ID NO: 462042 - DNA, 503 bp, Homo sapiens
  misc_feature: HEFZJCU01BQW46.10.23.C01.1.454.heavy.3.raw
catagtagtgcacgaccggtgctcgatttagtacacgtgattagggattggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcagctttgatgaatatgccatggactgggtccggcaagttccagggaagggcctggagtgggtctcaggtattgattggaatagtggtaccattgcctatgcggactctgtgaagggccgattcaccatcaccagagacgacgccaggagctccctgtatctccaaatgaacagtctgagacctgaggacacggccttgtattactgtgtaagaggggagtcagggtttcaaa

SEQ ID NO: 462043 - DNA, 501 bp, Homo sapiens
  misc_feature: HEFZJCU01BAH3J.40.68.G02.1.454.heavy.3.raw
tctagcgactcacgaccggtgctcgatttagtcgatagtgaagggaaaggggagggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggcccgagcgcagtggcttttgatgcctttgatatgtggggccgaagggacaat

SEQ ID NO: 462044 - DNA, 391 bp, Homo sapiens
  misc_feature: HEFZJCU01D46AG.16.70.G04.1.454.heavy.3.raw
tgtactactccacgaccggtgctcgatttagtgtagtgtgaagggaaggggctggagtggatcgggaatatctattatagtgggagcacctactacaacccgtccctcaagagtcgagtcgccatatccgtagacacgtccaagaaccacttctccctgaaactgagctctgtgaccgccgcagacacggctgtctattactgtgcgagacagagttacgacggtggttactccggtctctttgacaactggggccagggaaccctggtcaccgtctcctcagcctccaccaagggcccatcggtcttccccctggcaccctcctccaagagcacctctggggcacagcggccctgggctgcctggtcaaggactacttccgagtagtaca

SEQ ID NO: 462045 - DNA, 511 bp, Homo sapiens
  misc_feature: HEFZJCU01DUT59.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatccctccgggacagacttaccatgaccacgaactcctccataaacacagcctacatggagttgaggagcctgacatctgacgacacggccgtctattactgtgcgagagtcccacgactccggtgagcctacggcagcggcctttgacttctggggccaggggacg

SEQ ID NO: 462046 - DNA, 516 bp, Homo sapiens
  misc_feature: HEFZJCU01BOFAL.13.55.E11.1.454.heavy.3.raw
tcacgtactacacgaccggtgctcgatttagcactcgcacgttgggtttgggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtctgggggaggcttggtaaagccgggggggtcccttcgactctcctgtgcagcctctggaatcactttcagtgacgcctggatgaactgggtccgccaggctccagggaaggggctggagtggattggccgtattaaaagtgagcctgatggtgggacaacagactacgctgcacccgtgaagggcagattcaccatctccagagatgattcaaggaacacagtgtttctgcaaatgaacagcctgactgccggggacactgccgtgtattactgtgccagcagcagtacctggccactattattttttgacttcgtc

SEQ ID NO: 462047 - DNA, 507 bp, Homo sapiens
  misc_feature: HEFZJCU01ALG5U.13.39.D06.1.454.heavy.3.raw
  modified_base (485)..(485): a, c, t, g, unknown or other
tcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactggagtggattgggcttatcaatgccagtgggggcaccagcctacaacccctccctcaagagccgcgtcaccagtttcagtagacacgtccaagaaccagctctccctgaagctgagttctgtgaccgccgcagacacggccgtgtattactgtgcgcgacaggtggacgtctggggccaagggaccacggtcaccgtcncctcagcctccaccaagggccc

SEQ ID NO: 462048 - DNA, 519 bp, Homo sapiens
  misc_feature: HEFZJCU01BMA4D.52.28.C06.1.454.heavy.3.raw
cgcagtacgacacgaccggtgctcgatttagagctcacgtattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccggacaagggcttgtttggatgggatggatcaacgctggcaatggtaacacaaaatattcacagaagttccagggcagagtcaccatcaccagggacacatccgcgagcacagcctacatggagttgagcagcctgagaaatgaagacacggctgtatattactgtgcgaggaggggaaatggcctccaccgaacgggcccatcggtccttccccctggccacccctcctccaacg

SEQ ID NO: 462049 - DNA, 517 bp, Homo sapiens
  misc_feature: HEFZJCU01A4PBJ.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtcgagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctattatgtgtcatagacctaggatacaacgacggtggtacctggtattc

SEQ ID NO: 462050 - DNA, 414 bp, Homo sapiens; identical to SEQ ID NO: 453362
  misc_feature: HEFZJCU01BDV4P.40.81.H04.1.454.heavy.3.raw

SEQ ID NO: 462051 - DNA, 489 bp, Homo sapiens
  misc_feature: HEFZJCU01D678B.51.21.B10.1.454.heavy.3.raw
cgatcgtatacacgaccggtgctcgatttagtgtcgtcgcaagggggagggcatcatccaacaaccacatcccttctctacagaagcctctgagaggaaagttcttcaccatggactggacctggagggtcttctgcttgctggctgtagctccaggtgctcactccctggtgcagctggtgcagtctggggctgaggtgaagaagcctggggcctcagtgacgatttcctgtaggacatctggatacacgttcaccggctattttatgtactgggtgcgacaggccctggacaaggccttgagtggatgggaaagatcaacctagtggtggtaccacaagttacgcccagaaattccagggcagagtctccatgaccagaaatacgtccgcgaggacagtctacatggagttgagcagcctgagaactgacgacacggccatatattactgtgcgagagaccttgcttggtccttttgacttctgggg

SEQ ID NO: 462052 - DNA, 489 bp, Homo sapiens; identical to SEQ ID NO: 444591
  misc_feature: HEFZJCU01CMQHA.18.70.G04.1.454.heavy.3.raw

SEQ ID NO: 462053 - DNA, 493 bp, Homo sapiens; identical to SEQ ID NO: 453100
  misc_feature: HEFZJCU01ETIJM.14.25.C03.1.454.heavy.3.raw

SEQ ID NO: 462054 - DNA, 482 bp, Homo sapiens
  misc_feature: HEFZJCU01A7B4U.52.32.C10.1.454.heavy.3.raw
cgcagtacgacacgaccggtgctcgatttagtatagacatcaacacacaaagggggggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctgaagacacggctgtatattactgtgacgaactt

SEQ ID NO: 462055 - DNA, 489 bp, Homo sapiens; identical to SEQ ID NO: 444791
  misc_feature: HEFZJCU01BABFS.47.85.H08.1.454.heavy.3.raw

SEQ ID NO: 462056 - DNA, 399 bp, Homo sapiens
  misc_feature: HEFZJCU01E2GJ0.16.80.H03.1.454.heavy.3.raw
tgtactactccacgaccggtgctcgatttagctgtgcgtcgaagggaaagggactggatatgtttcagctattagttataatgggggtaacacatactacgcagactcagtgaagggcagattcaccatctccagagacaattcccagaacacgctggatcttcaaatgagcagtctgagagctgaggacacggctgtgtattactgtgtgaaagatttccgtggctactacgactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 462057 - DNA, 519 bp, Homo sapiens
  misc_feature: HEFZJCU01D4XMN.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcagggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgtctggggccaggggaccctggtcatcgtctccccagcctccaccaagggcccatcggtcttcccctggcc

SEQ ID NO: 462058 - DNA, 546 bp, Homo sapiens
  misc_feature: HEFZJCU01E2DNH.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaagtaataggctgtgtttagtttgggtccggtacgggaggcccgtcggtcgtaccg

SEQ ID NO: 462059 - DNA, 513 bp, Homo sapiens
  misc_feature: HEFZJCU01DQKHT.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaacacagggactgcagtggattggatacatctacttcagtgggaaccccaactacaacccctccctcaggagtccagtcgccatatccctggactcgtccaacaaccagatctccctgacgatgacatctgtgaccgctgcggacacagccgtttattactgtgcgcgatctgggcgactcagtgactatggtatggacgtctggggccaagggaccacggtcatcgtctcctcagcctccaccaagggcccatcggtcttccccctggcca

SEQ ID NO: 462060 - DNA, 501 bp, Homo sapiens; identical to SEQ ID NO: 447719
  misc_feature: HEFZJCU01C5KBG.17.10.A10.1.454.heavy.3.raw

SEQ ID NO: 462061 - DNA, 519 bp, Homo sapiens
  misc_feature: HEFZJCU01CXNMY.49.59.F04.1.454.heavy.3.raw
agtcgagagacacgaccggtgctcgatttagtacacacacttagggattggggcagctacaggtgtccagtcccaggtccagctggtgcaatctggggctgaggtgaagaagcctgggtcctcggtgaaggtctcctgtaaggcttctggaggcaccctcagcagttatactatgaattgggtgcgacaggcccctggacaagggcttgagtggatggggaggatcatccctattgttggtgtgacaaactacgcacagaagttccaggacagaatcacgataaccgcggacacatccacgagcactattttcatggaactgagcagcctcagatccgaggacacggccgtttactactgtgcgagcgatcccggattcccgcgtttcgaggatgactactggggccagggaaccctggtcaccgtctcctcagcctccaccaagggcccatcggtcttcccctggcaccctcctccagagcacctctgggggcacagcgccctgggctgcctggtcaa

SEQ ID NO: 462062 - DNA, 536 bp, Homo sapiens
  misc_feature: HEFZJCU01DSS64.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaagggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtatggctgtgtttattggggccaggggagcccgtggtctaccg

SEQ ID NO: 462063 - DNA, 400 bp, Homo sapiens; identical to SEQ ID NO: 444452
  misc_feature: HEFZJCU01EBW77.47.24.C02.1.454.heavy.3.raw

SEQ ID NO: 462064 - DNA, 535 bp, Homo sapiens
  misc_feature: HEFZJCU01D6PI5.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaacgggttgcacttatttattgggatgacggttaccgctacagtccatctctgaggaggagactcaccatcaccaaggacacccccaaaaaccaggtggtccttacaatgaccaccatggaccctgtggacacagccacatatttctgtgcacactctataggagcacctggtagtctgccaaactggttcgacccctggggcccgggaaccctcggtcaccgtctcctcagcctccaccaacgggcccatcggtccttcccc

SEQ ID NO: 462065 - DNA, 507 bp, Homo sapiens
  misc_feature: HEFZJCU01A5M56.9.12.B01.1.454.heavy.3.raw
tgatacgtctcacgaccggtgctcgatttagtagtgtagattccgcggggtgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagcctggggggtccctgaaactctcctgtgcagcctctggatacaccgtcagtagtaactccatgaactgggtccgccaggctccagggaaggggctggagtgggtctcagttatttatagcggtggtaacacatactacgcagactccgtgaagggcagattcaccatctccagagacaattccaggaacacgctgtatcttcaaatgaacagcctgagagtcgaggacacggctgtatattactgtgcgagagatgtgtacgcttttgatatctggggccaagggac

SEQ ID NO: 462066 - DNA, 499 bp, Homo sapiens
  misc_feature: HEFZJCU01AXW91.47.38.D05.1.454.heavy.3.raw
agctcacgtacacgaccggtgctcgatttagtatctgatagttgggtttgggggagagcatcacccagcaaccacatctgtcctctagagaatcccctgagagctccgttcctcaccatggactggacctggaggatcctcttcttggtggcagcagccacaggagtccactcccagttgcaactggtgcagtctggggctgaggtgaagaagcctggggcctcagtgaaggtctcctgcaaggcttctggatacagcttcaccgactactatttgcactgggtgcgacgggcccctggacaagggcttgagtggatgggacggatcagccctaacagtggtggcacaaactatgcacagaggtttcagggcagggtcaccatgaccagggacacggtccatcagtacagcctacatggagctgagcagtctgagacctgacgacacggccgtgtattattgtgcgttagttacggacgattacgacgttttgattggt

SEQ ID NO: 462067 - DNA, 382 bp, Homo sapiens
  misc_feature: HEFZJCU01BN803.18.60.F05.1.454.heavy.3.raw
  modified_base (255)..(255): a, c, t, g, unknown or other
tacgagtatgcacgaccggtgctcgatttagtacgtcatcagggaaaggggctggaatatattgggattacctcttacagtgggaccacccattacaacccgtccctcaaaagtcgactcaccatttccgtggacacgtcgaaaaacgagttctccctggacttgacctctgtgaccgccgcagacacggctgtttattactgtgcgagacgactacctgactccaatccatactttgactattggggccggganccctggtcaccgtctcctcagcctccaccaaggccatcggtcttcccctggcgccctgctccaggagcacctccgagagcacagcggccctgggctgcctggtcaaggactacttcccatactcgta

SEQ ID NO: 462068 - DNA, 507 bp, Homo sapiens; identical to SEQ ID NO: 446637
  misc_feature: HEFZJCU01CXD7E.16.34.D01.1.454.heavy.3.raw

SEQ ID NO: 462069 - DNA, 545 bp, Homo sapiens
  misc_feature: HEFZJCU01CM18O.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggctttttcttgtggctttttaaaaggtgcctagtgtgaggtgcaactgttggagtctgggggaggcttggtacagccggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattactgtgcgaaggatcgcccctataatggtggttggagtcggggagtttggttcctggggccagggaaccctggtctaccg

SEQ ID NO: 462070 - DNA, 400 bp, Homo sapiens; identical to SEQ ID NO: 444452
  misc_feature: HEFZJCU01DN7X3.47.24.C02.1.454.heavy.3.raw

SEQ ID NO: 462071 - DNA, 521 bp, Homo sapiens
  misc_feature: HEFZJCU01BVC5X.13.76.G10.1.454.heavy.3.raw
tcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacgaacgttactacgctatggacgtcgtggggccaagggaccg

SEQ ID NO: 462072 - DNA, 457 bp, Homo sapiens
  misc_feature: HEFZJCU01C159M.15.28.C06.1.454.heavy.3.raw
tctacgtagccacgaccggtgctcgatttagagctcacgtattgggtttgggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttggggccagggaaccctggtcaccgtctcctcagcctccaccaagggcccatcggtcttccccctggcgccctgctccaggagcacctccgagagcacagcggccctgggctgcctggtcaaggactacttccgctacgtaga

SEQ ID NO: 462073 - DNA, 486 bp, Homo sapiens
  misc_feature: HEFZJCU01E08R6.47.85.H08.1.454.heavy.3.raw
agctcacgtacacgaccggtgctcgatttagtatcactcagtcggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctccgagagcacagcggcctgggctgcctggtcaaggactacttcctacgtgagct

SEQ ID NO: 462074 - DNA, 469 bp, Homo sapiens
  misc_feature: HEFZJCU01AHXPK.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggcccatcggtcttcccctggcgccctgctccaggagcacctccgagagcacagcggcctgggctgcctggtcaaggactacttccctacagtgct

SEQ ID NO: 462075 - DNA, 495 bp, Homo sapiens
  misc_feature: HEFZJCU01C3UON.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttcccctggcgccctgctccagagcacctccgagagcacagcggccctgggctgcctggtcaaggactac

SEQ ID NO: 462076 - DNA, 540 bp, Homo sapiens
  misc_feature: HEFZJCU01BJXZ3.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggctttttcttgtggctttttaaaaggtgcccagtgtgaggtgcaactgttggagtctgggggaggcttggtacagccggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattactgtgcgaaggatcgccctataatggtggctggatcggggagtttggttccgtggggccagggaacccctgggt

SEQ ID NO: 462077 - DNA, 523 bp, Homo sapiens; identical to SEQ ID NO: 447984
  misc_feature: HEFZJCU01CRRQH.12.86.H09.1.454.heavy.3.raw

SEQ ID NO: 462078 - DNA, 510 bp, Homo sapiens
  misc_feature: HEFZJCU01BY9CC.48.25.C03.1.454.heavy.3.raw
agtatacatacacgaccggtgctcgatttagtagtgtagatttgggtttgggggagccttggtgcagcctggagagtccctaagactctcctgcgcagcctcaggattcagtttcagtagttatgaaatgaattgggtccgccaggctccagggaagggactggagtggctttcatatattactggcagtgggtctcttacccattatgcagactctgtgaggggccgattcaccatctccagagacaacccccgaaactctctttttctgcaaatggacagcctgacagccgacgatacggccatttattactgtgcgagagatgggacccccgcatatccagaaggcacactctactttgacctctggggccaggggatcctggtcaccgtctcctcagcctccaccaagggcccatcggtcttccccctggcgccctgctccaggagcacctccgagagcacagcggccctgggctgcctggtcaaggactacttcctatgtatact

SEQ ID NO: 462079 - DNA, 516 bp, Homo sapiens
  misc_feature: HEFZJCU01BQBKO.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgttcttcaaatgaacagcctgagagccgatgacacggccgtgtattactgtgcgagagatggggccacgaacgttactacgctatggacgtctggggccaagggacc

SEQ ID NO: 462080 - DNA, 396 bp, Homo sapiens; identical to SEQ ID NO: 444469
  misc_feature: HEFZJCU01AHUQS.47.46.E02.1.454.heavy.3.raw

SEQ ID NO: 462081 - DNA, 518 bp, Homo sapiens
  misc_feature: HEFZJCU01DO7ER.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccaggggaaccctggtcaccgtctcctcagcctccaccaaggccatcggtcttcccctggcaccctcctccaagagcacctctgggggcacagcggccctgggctgcctggtcaaggactacttcctagagacacg

SEQ ID NO: 462082 - DNA, 500 bp, Homo sapiens; identical to SEQ ID NO: 446033
  misc_feature: HEFZJCU01DRCOY.11.27.C05.1.454.heavy.3.raw

SEQ ID NO: 462083 - DNA, 508 bp, Homo sapiens
  misc_feature: HEFZJCU01C2ZW4.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaggagggggaaccagcgggagtcaagtactcttgacgtctgggcc

SEQ ID NO: 462084 - DNA, 499 bp, Homo sapiens
  misc_feature: HEFZJCU01BEFBP.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggatgacctctgacgacacggccatgtattactgtggaagagacgttggtggctaccgcggggctgaccacgtgggccg

SEQ ID NO: 462085 - DNA, 486 bp, Homo sapiens
  misc_feature: HEFZJCU01DWCOX.16.12.B01.1.454.heavy.3.raw
tgtactactccacgaccggtgctcgatttagtagtgtagatttgggcttggaacagcctggggggtccctgagactctcctgtgcaacctctggattcacctttaccagctatgccatgagctgggtccgccaggctccagggaaggggctggagtgggtcgcagccattagtggtattcgtgatgccacatactacgcagactccgtgaggggccggttcaccatctccagcgacacttccaggagcacgttgtatctgcaaatgaacagcctgagagtcgaggacacggccctatattactgtgcgaaagataagatttggggacccgatgcttatgatagctggggccaagggacaatggtcaccgtctcttcagcctccaccaagggcccatcggtcttcccctggcaccctcctccaagagcgcctctgggggcacagcggccctgggctgcctggtcaaggactacttccgagtagtaca

SEQ ID NO: 462086 - DNA, 400 bp, Homo sapiens; identical to SEQ ID NO: 444452
  misc_feature: HEFZJCU01EFMD5.47.24.C02.1.454.heavy.3.raw

SEQ ID NO: 462087 - DNA, 519 bp, Homo sapiens
  misc_feature: HEFZJCU01BDROM.40.38.D05.1.454.heavy.3.raw
tctagcgactcacgaccggtgctcgatttagtatctgatagttgggtttggggatgctttctgagagtcagggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggttggatccgccagcccccagggaaggggctggagtggattgggagtatgcactatagtgggagcacccactacaccccgtccctcaagagtcgagtcaccatatccgtagacacgtccaagaatcagttctccctgaagctgacctctgtgaccgccgcagacacggctgtttattactgtgtgagacgggtgccccaagaaaaagtgttttatccctggggccagggaaccctggtcaccgtctcctcagcctccaccaac

SEQ ID NO: 462088 - DNA, 379 bp, Homo sapiens; identical to SEQ ID NO: 444450
  misc_feature: HEFZJCU01AHH3N.47.77.G11.1.454.heavy.3.raw

SEQ ID NO: 462089 - DNA, 484 bp, Homo sapiens; identical to SEQ ID NO: 445311
  misc_feature: HEFZJCU01AFQYC.11.23.C01.1.454.heavy.3.raw

SEQ ID NO: 462090 - DNA, 505 bp, Homo sapiens
  misc_feature: HEFZJCU01EKP5I.13.39.D06.1.454.heavy.3.raw
tcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggcccgtgtattactgtgcgcgacaggtggacgtctggggccaagggaccacggtcaccgtctcctcagcctccaccaaggccc

SEQ ID NO: 462091 - DNA, 524 bp, Homo sapiens
  misc_feature: HEFZJCU01B0NVL.48.70.G04.1.454.heavy.3.raw
agtatacatacacgaccggtgctcgatttagtgtagtgtgaagggaaagggggctttctgagagtcagggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggttggatccgccagcccccagggaaggggctggagtggattgggagtatgcactatagtgggagcacccactacaccccgtccctcaagagtcgagtcaccatatccgtagacacgtccaagaatcagttctccctgaagctgacctctgtgaccgccgcagacacggctgtttattactgtgtgagacgggtgccccaagaaaaagtgtttatcccgtggggccagggaaccctggtcaccgtctcctcagcctccaccaaggcccatcc

SEQ ID NO: 462092 - DNA, 486 bp, Homo sapiens
  misc_feature: HEFZJCU01DDFW8.49.27.C05.1.454.heavy.3.raw
agtcgagagacacgaccggtgctcgatttagacgcgatcgaagggtttggggtgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctagaagacacggctgtatattactgtgcgaacttaatcac

SEQ ID NO: 462093 - DNA, 378 bp, Homo sapiens; identical to SEQ ID NO: 444463
  misc_feature: HEFZJCU01AR1EU.47.77.G11.1.454.heavy.3.raw

SEQ ID NO: 462094 - DNA, 407 bp, Homo sapiens; identical to SEQ ID NO: 444621
  misc_feature: HEFZJCU01DZFUQ.40.22.B11.1.454.heavy.3.raw

SEQ ID NO: 462095 - DNA, 509 bp, Homo sapiens
  misc_feature: HEFZJCU01BDL8S.4.26.C04.1.454.heavy.3.raw
agcactgtagcacgaccggtgctcgatttagtctagcgactttgggtttggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagttggtggagtctgggggaggcttggtacagcctgggggtccctgagactctcctgtacagactctggattcacctttagcagccatgccatgagctgggtccgccaggctccagggaaggggctggagtgggtctcagcaattagtggaggtggtggtggtggtacatactacgcaaactccgtgaggggccgattcaccatctccagagacaattccaagaacacgttatatctgcaaatgaacagcctgcgagccgacgacacggccgtatattactgtgcgaaatgccttattgcgaccgagcgtagc

SEQ ID NO: 462096 - DNA, 405 bp, Homo sapiens
  misc_feature: HEFZJCU01BI5OP.13.46.E02.1.454.heavy.3.raw
tcacgtactacacgaccggtgctcgatttagactcatctacagggaaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgacccctggggcccgggaaccctggtcaccgtctcctcagcctccaccaagggcccatcggtcttccccctggcaccctcctccaagagcacctctgggggcacagcggccctgggctgcctggtcaaggactacttcctagtacgtga

SEQ ID NO: 462097 - DNA, 492 bp, Homo sapiens; identical to SEQ ID NO: 446706
  misc_feature: HEFZJCU01EQNL4.11.71.G05.1.454.heavy.3.raw

SEQ ID NO: 462098 - DNA, 396 bp, Homo sapiens
  misc_feature: HEFZJCU01A7LPX.13.61.F06.1.454.heavy.3.raw
tcacgtactacacgaccggtgctcgatttagctacgctctaagggaaagggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgcaaaagatccaaccccttacgatttttggagtggttataccgagtggggccagggaaccctggtcatcgtctcctcagcctccaccaagggcccatcggtcttccccctggcaccctcctccaagagcacctctgggggcacagcggccctgggctgcctggtcaaggactacttcctagtacgtga

SEQ ID NO: 462099 - DNA, 511 bp, Homo sapiens
  misc_feature: HEFZJCU01DNP89.53.70.G04.1.454.heavy.3.raw
cgcgtatacacacgaccggtgctcgatttagtgtagtgtgaagggaaagggtggagtctgggggagacttgatacagcctggcaggtccctgagactctcctgtgcagcctctggattcacgtttgatgattctgtcatgcactgggtccggcaaactccagggaagggcctggagtggctctcaggcattacttggaatagtggcagtacaggttatgcggactctgtgaagggccgattcaccatctccagagacaacagcaaggagctcctttatttacaaatggacagcctgagagttgaggacacggccgtatattactgtgtgaaagacagcggcccacctcgcagttggtattactattacgggatggacatctggggccgagggaccacgggtcaccgtctcctcagcctccaccaagggcccatcggtcttccccctggcgccctgctccaggagcacctccgagagcacagcggcctgggctgcctggtcaaggactactt

SEQ ID NO: 462100 - DNA, 492 bp, Homo sapiens
  misc_feature: HEFZJCU01DVC2O.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtccttcccctggcaccctcctccaagagcacctctgggggcacagcggccctgggctgcctggtcaaggactacttccgagtgcgtct

SEQ ID NO: 462101 - DNA, 509 bp, Homo sapiens
  misc_feature: HEFZJCU01EL38M.13.10.A10.1.454.heavy.3.raw
  modified_base (470)..(470): a, c, t, g, unknown or other
tcacgtactacacgaccggtgctcgatttagcgtcgatctcagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagttggaagtgagaaatactatgtggactccgtgaggggccattcaccatctccagagacaattccaagacacgctgttcttcaatgaacagcctgagagtcgatgacacggccgtgtattactgtgcgagngagtcgggccacgaacgttactacgctatggacgtcgtc

SEQ ID NO: 462102 - DNA, 357 bp, Homo sapiens
  misc_feature: HEFZJCU01AL6DX.47.38.D05.1.454.heavy.3.raw
agctcacgtacacgaccggtgctcgatttagtatctgatagttgggtttgggtggcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactacttcctacgtgagct

SEQ ID NO: 462103 - DNA, 511 bp, Homo sapiens
  misc_feature: HEFZJCU01D0N18.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtgcgttttctaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagtttagcacccatactactttgactactggggccg

SEQ ID NO: 462104 - DNA, 482 bp, Homo sapiens
  misc_feature: HEFZJCU01CQGNW.19.71.G05.1.454.heavy.3.raw
tactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagaggccccatagacatgccacctcgtctctggtgct

SEQ ID NO: 462105 - DNA, 510 bp, Homo sapiens
  misc_feature: HEFZJCU01EE95I.40.81.H04.1.454.heavy.3.raw
  modified_base (442)..(442): a, c, t, g, unknown or other
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcaagggcagggtcaccatgacctgggacgcgtccatcagcacagtctacatggatctgagcggactgacctacgtgaccganacggccatgtattacgtgtaggaagaggacgtggtggctaccggcggggctggaacctcgtggggacc

SEQ ID NO: 462106 - DNA, 515 bp, Homo sapiens
  misc_feature: HEFZJCU01EZTHL.47.53.E09.1.454.heavy.3.raw
agctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactcatttattgggatgatgtgaagtactacagtccatatttcaagaggctcactatcaccaaggacacttccaaaaaccaagtggtcctgacaatgaccaacgtgaagcctgcggacacggccacatattattgtgcacaccgacgctataacccgccagctgggaaatcgaacaactggtcgaccctgggccagggaaccttgtcaccgtctcctcagcctccaccaagggccc

SEQ ID NO: 462107 - DNA, 489 bp, Homo sapiens
  misc_feature: HEFZJCU01DKTGI.51.67.G01.1.454.heavy.3.raw
  modified_base (435)..(435): a, c, t, g, unknown or other
cgatcgtatacacgaccggtgctcgatttagagtatacatattgggtttgggggggagaggagcccagcactagaagtcggcggtgcttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctcagagacaactccgagaacacgctgtatctgcaaatgaacnggctgagagctagaagacacggctgtatagttactgtgcgtaaacttaatcaac

SEQ ID NO: 462108 - DNA, 409 bp, Homo sapiens; identical to SEQ ID NO: 444519
  misc_feature: HEFZJCU01BQWD0.3.41.D08.1.454.heavy.3.raw

SEQ ID NO: 462109 - DNA, 522 bp, Homo sapiens
  misc_feature: HEFZJCU01EO37T.9.37.D04.1.454.heavy.3.raw
tgatacgtctcacgaccggtgctcgatttagtagcatactgttgggtttgggggagccctggtacagccgggggggtccctgacactctcctgtacagcctctggattcacctttaacacctatgcattgagctgggtccgccaggccccagggaaggggctggactgggtcgcagccattagtggcaatggcgaaaacacatattacgcagactccgtgaagggccggttcaccatttccagagacaatttcaagaacacgctgtatctgcagatgaacagcctgagagccgaggacacggccgtatatcactgtgccaaagatcagaaggacggttcggggagttacaaatattactacttctactatggaatggacgtctggggccgagggaccacggtcaccgtctcctcagcctccaccaaggcccatcggtcttcccctgccaccctcctccaagagcacctctgggggcacagcggccctgggctgcctggtcaaggactactccagacgtatca

SEQ ID NO: 462110 - DNA, 491 bp, Homo sapiens; identical to SEQ ID NO: 444592
  misc_feature: HEFZJCU01EQFL1.11.26.C04.1.454.heavy.3.raw

SEQ ID NO: 462111 - DNA, 514 bp, Homo sapiens; identical to SEQ ID NO: 448164
  misc_feature: HEFZJCU01EEILP.3.34.D01.1.454.heavy.3.raw

SEQ ID NO: 462112 - DNA, 500 bp, Homo sapiens; identical to SEQ ID NO: 447386
  misc_feature: HEFZJCU01DUKPZ.17.10.A10.1.454.heavy.3.raw

SEQ ID NO: 462113 - DNA, 504 bp, Homo sapiens
  misc_feature: HEFZJCU01CLCL2.11.6.A06.1.454.heavy.3.raw
cgagagataccacgaccggtgctcgatttagatctactgacagggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtctgggggaggcttggtaaagccgggggggtcccttagactctcctgtgcagcctctggcatcactttcagtgacgcctggatgagctgggtccgccaggctccagggaagggctggagtgggttggccgtattaaagcgaggctgctggtgggacaacagactacgctgcacccgtgaagggcagattcaccatctccagagatgattcaaggagcacagtgtttctacaatgaacagcctgactgccggggacactgccgtgtattactgtgccagcagcagcacctggcccactatatttctttcg

SEQ ID NO: 462114 - DNA, 497 bp, Homo sapiens; identical to SEQ ID NO: 445179
  misc_feature: HEFZJCU01AWIFB.12.55.E11.1.454.heavy.3.raw

SEQ ID NO: 462115 - DNA, 482 bp, Homo sapiens; identical to SEQ ID NO: 453190
  misc_feature: HEFZJCU01BLSFG.10.35.D02.1.454.heavy.3.raw

SEQ ID NO: 462116 - DNA, 541 bp, Homo sapiens
  misc_feature: HEFZJCU01BG421.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgcaaatgaacagcctgaaaccgaggacacggccgtgtattactgtactagacaggtggattacagtttgggggagtttatcgacgaaacgggggggtactacgtacgctt

SEQ ID NO: 462117 - DNA, 524 bp, Homo sapiens
  misc_feature: HEFZJCU01AW9PO.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggccagggggaccctggtcatcgtctccccagcctccaccaagggcccatcggtcttcccctggccg

SEQ ID NO: 462118 - DNA, 519 bp, Homo sapiens
  misc_feature: HEFZJCU01B6K92.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccagagcacctccgagagcacagcggcctggctgcctggtcaggactactcc

SEQ ID NO: 462119 - DNA, 514 bp, Homo sapiens
  misc_feature: HEFZJCU01DAGA5.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccg

SEQ ID NO: 462120 - DNA, 511 bp, Homo sapiens
  misc_feature: HEFZJCU01CH6DR.53.34.D01.1.454.heavy.3.raw
cgcgtatacacacgaccggtgctcgatttagatcgtctgtgtttccattcggtgatcagcactgaacacagaggactcaccatggagttttggctgagctgggttttccttgttgctattttaaaaggtgtccagtgtgaggtgcagctggtggagtctggaggaggcttggtccagcctggggggtccctgagactctcctgtgcagcctctggattgaccgtcagtagcaactacatgagctgggtccgccaggccccagggaaggggctggagtgggtctcaacaatttatagcggtggtaggacataccacgcagaccccgtgaagggccgattcaccatctccagacacaattccaagaacacactgtttcttcaaatggacttcctgagaactgaggacacggccgtggtattactgcgcgagagtgcatgatagtggtttccatgatgcttttgatgtctggggccaagggacaatggtcaccgtctcttcagcctcctacccg

SEQ ID NO: 462121 - DNA, 499 bp, Homo sapiens
  misc_feature: HEFZJCU01D1RZU.13.33.C11.1.454.heavy.3.raw
tcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacaggggtcaccatgaccacggacacgtccatcaacacagcctacatggaactgaggagcctaagatctgacgacacggccgtttattattgtgcaataagaattgcaacgatgcttttagatatgtgggacg

SEQ ID NO: 462122 - DNA, 396 bp, Homo sapiens; identical to SEQ ID NO: 445818
  misc_feature: HEFZJCU01A6090.16.68.G02.1.454.heavy.3.raw

SEQ ID NO: 462123 - DNA, 514 bp, Homo sapiens
  misc_feature: HEFZJCU01E0KWQ.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagcgtgtcgtttctaggtggctattttaaaaggtgtccagtgtgaggtgcagctgttggagtctgggggaggcttggcacagcctggggggtccctgagactctcctgtgcagcctctggattcacctttgacagctatgccatgacctggggtccgccaggctccagggaaggggctggaatgggtctcaggtattacgtggtggtggttaataccacatactacgcagactccgtgaagggccggttcaccatcctccagagacaattccaagaacacactgtatctgcaaatgaacagcctgagagccgacgacacggccatatattactgtgcgaaagcaccggcagttagtcacccatactactttgactactgggccg

SEQ ID NO: 462124 - DNA, 374 bp, Homo sapiens; identical to SEQ ID NO: 459994
  misc_feature: HEFZJCU01DFIXZ.49.69.G03.1.454.heavy.3.raw

SEQ ID NO: 462125 - DNA, 515 bp, Homo sapiens
  misc_feature: HEFZJCU01DBIPK.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaaggaggggggaaccagcgggagtccaagtactcctttg

SEQ ID NO: 462126 - DNA, 508 bp, Homo sapiens; identical to SEQ ID NO: 445594
  misc_feature: HEFZJCU01BBNH4.17.25.C03.1.454.heavy.3.raw

SEQ ID NO: 462127 - DNA, 513 bp, Homo sapiens; identical to SEQ ID NO: 446452
  misc_feature: HEFZJCU01C7U3Z.17.33.C11.1.454.heavy.3.raw

SEQ ID NO: 462128 - DNA, 522 bp, Homo sapiens; identical to SEQ ID NO: 446788
  misc_feature: HEFZJCU01A3BYA.12.40.D07.1.454.heavy.3.raw

SEQ ID NO: 462129 - DNA, 513 bp, Homo sapiens; identical to SEQ ID NO: 446699
  misc_feature: HEFZJCU01DJN2O.12.25.C03.1.454.heavy.3.raw

SEQ ID NO: 462130 - DNA, 396 bp, Homo sapiens
  misc_feature: HEFZJCU01DQ7RX.18.31.C09.1.454.heavy.3.raw
tacgagtatgcacgaccggtgctcgatttagacgtctcatcaaggaaggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactggggccagggcactccggtcaccgtctcctcagcttccaccaagggcccatcggtcttccccctggcgccctgctccaggagcacctctgggggcacagcggccctgggctgcctggtcaaggactacttcccatactcgta

SEQ ID NO: 462131 - DNA, 509 bp, Homo sapiens
  misc_feature: HEFZJCU01EHXJJ.47.55.E11.1.454.heavy.3.raw
  modified_base (493)..(493): a, c, t, g, unknown or other
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgtttcgatgccttcggtccgcgggacttcnggggccagggaaccct

SEQ ID NO: 462132 - DNA, 316 bp, Homo sapiens; identical to SEQ ID NO: 444479
  misc_feature: HEFZJCU01E15DT.47.84.H07.1.454.heavy.3.raw

SEQ ID NO: 462133 - DNA, 480 bp, Homo sapiens
  misc_feature: HEFZJCU01EH934.19.71.G05.1.454.heavy.3.raw
tactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagaggccccataga

SEQ ID NO: 462134 - DNA, 521 bp, Homo sapiens; identical to SEQ ID NO: 445317
  misc_feature: HEFZJCU01BNPSO.12.40.D07.1.454.heavy.3.raw

SEQ ID NO: 462135 - DNA, 507 bp, Homo sapiens
  misc_feature: HEFZJCU01B8TH0.14.35.D02.1.454.heavy.3.raw
cgtctagtaccacgaccggtgctcgatttagcacacgatagttaggtttgggggcatcacataacaaccagattcctcctctaaagaagcccctgggagcacagctcatcaccatggactggacctggaggttcctctttgtggtggcagcagctacagctgtccagtcccaggtccagctggtgcagtctggggctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggccacagcctacatggagttgagcggcctgagatttgacgacacggccttctattactgtgcgagagaactcgctacgataatatgccttgcctctgactactgggccg

SEQ ID NO: 462136 - DNA, 515 bp, Homo sapiens
  misc_feature: HEFZJCU01C5ZWU.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccaggcggagttccaagtactc

SEQ ID NO: 462137 - DNA, 398 bp, Homo sapiens; identical to SEQ ID NO: 444798
  misc_feature: HEFZJCU01AYVJV.4.60.F05.1.454.heavy.3.raw

SEQ ID NO: 462138 - DNA, 514 bp, Homo sapiens
  misc_feature: HEFZJCU01AZET9.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaatccaggaacacaatgtatttggaaatgaacagcctaagtcctgaggacacgggtgtatactactgtacgaaggagggggaaccaggcggagtccaagtactccg

SEQ ID NO: 462139 - DNA, 523 bp, Homo sapiens
  misc_feature: HEFZJCU01CTIMN.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagacccagacgacacggctgtctattattgcgcgagagagacacacgaacctactggccaatactatgggggcttgtctggggccaggggaccctgggtcactcgtctccccagcctccaccaagggcccatcggtctcccctggccg

SEQ ID NO: 462140 - DNA, 507 bp, Homo sapiens
  misc_feature: HEFZJCU01DLKFQ.40.68.G02.1.454.heavy.3.raw
tctagcgactcacgaccggtgctcgatttagtcgatagtgaagggaaaggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtctttttgatgcctttgatatgtggggccgaagggacaagtggtctaccg

SEQ ID NO: 462141 - DNA, 508 bp, Homo sapiens
  misc_feature: HEFZJCU01EQE7K.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagtcttttgatctctggggccaagggacacgtggtcaccgtctcttcagcctcaccaagggcccatcggtctcccctggccgcctgcctccaggacg

SEQ ID NO: 462142 - DNA, 497 bp, Homo sapiens
  misc_feature: HEFZJCU01ECZEM.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctgggccgtggcaccctgctgactgtctcctcagcctccaccaagggcccatcggtcttcccctggcgccctgctccaggagcacctccgagagcacagcggccctcgggctgcctggtcaaggactacc

SEQ ID NO: 462143 - DNA, 503 bp, Homo sapiens
  misc_feature: HEFZJCU01EHCPO.9.33.C11.1.454.heavy.3.raw
tgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggataccagtggcagctccaagtactactttgacttctggggccagggaaccctggtcaccgtctcctcagcctccaccaagggcccatcggtcttcccctggcgccctgctccaggagcacctccgagagcacagcggccctggctgcctggtcaaggactacttccagacgtatca

SEQ ID NO: 462144 - DNA, 501 bp, Homo sapiens
  misc_feature: HEFZJCU01CG7RU.40.34.D01.1.454.heavy.3.raw
tctagcgactcacgaccggtgctcgatttagatcgtctgtgccgaggtgcagctggtgcagtctggagcagaggtgaaaaagcccggggagtctctgaagatctcctgtaagggttttggatacaactttaccatctactggatcgcctgggtgcgccagatgcccgggaaaggcctagagtgggtgggaatcgtctatcctgacgactctgataccagatacagcccgtccttccaaggccaggtcaccatctcagccgacaagtccgtcaataccgcctacctgcagtggagcagtctgcaggcctcggacaccgccatgtacttctgtgcgagagggttcggggatgactactggggccagggaaccctggtcaccgtctcttcagcttccaccaagggcccatcggtcttcccctggcgccctgctccaggagcacctctgggggcgacagcggcccgtcgggctgcctggtcgaaggactacttccagtcgctaga

SEQ ID NO: 462145 - DNA, 542 bp, Homo sapiens; identical to SEQ ID NO: 453742
  misc_feature: HEFZJCU01A0PW8.18.59.F04.1.454.heavy.3.raw

SEQ ID NO: 462146 - DNA, 534 bp, Homo sapiens; identical to SEQ ID NO: 445832
  misc_feature: HEFZJCU01A23A3.17.28.C06.1.454.heavy.3.raw

SEQ ID NO: 462147 - DNA, 540 bp, Homo sapiens
  misc_feature: HEFZJCU01C1CGV.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatggacggttaccgctacagtccatctctgaggaggagactcaccatcaccaaggaccacccccaaaaaccaggtggtccttacaatgaccaccatggaccctgtggacacagccacatatttctgtgcacactctataggagcacctggtagtctgccaaactggttcgaccccgtcggggcccgggaacccgtcggtcaccgtctcctcagcctccaccacggcccatcggtccttcccctc

SEQ ID NO: 462148 - DNA, 500 bp, Homo sapiens; identical to SEQ ID NO: 446033
  misc_feature: HEFZJCU01CK3YZ.11.27.C05.1.454.heavy.3.raw

SEQ ID NO: 462149 - DNA, 313 bp, Homo sapiens; identical to SEQ ID NO: 444518
  misc_feature: HEFZJCU01EOJ9X.7.10.A10.1.454.heavy.3.raw

SEQ ID NO: 462150 - DNA, 504 bp, Homo sapiens
  misc_feature: HEFZJCU01E08OV.51.35.D02.1.454.heavy.3.raw
cgatcgtatacacgaccggtgctcgatttagcacacgatagttgggtttggggagctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatcctccagagacaactcgaagaatacggttcttctacaaatgaacagcctgagagctgaggacacggctatgttttactgtgcgagagggaactcgattacagcacg

SEQ ID NO: 462151 - DNA, 510 bp, Homo sapiens
  misc_feature: HEFZJCU01CFLE0.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacgaacgttactacgctatggacgtcgtgggg

SEQ ID NO: 462152 - DNA, 508 bp, Homo sapiens
  misc_feature: HEFZJCU01CDP5M.49.41.D08.1.454.heavy.3.raw
agtcgagagacacgaccggtgctcgatttagtcacgcgagaaagggaaagggtctgtgaagccttcacagaccctgtccctcacctgcgctgtctctggtggctccatcaccagtggtggttattcctggacttggatccggcagccaccagggaaggccctggagtggattgggcacatctatcatagtgggaccacctactacaacccgtccctccagagtcgagtcaccatatcagtcgacatgtccgagaaccagttctccctgtacctccactctgtgaccgccgcggacacggccgtctattactgtgccagaggggaactctacttcggggagttaggaatcgctcctgcatttgacatctggggccagggaaacctggtcaccgtctcctcagcctccaccaagggcccatcggtcttcccctggcaccctcctccaagagcacctctggggcacagcggccctgggctgcctggtcaaggactacttcctctctcgact

SEQ ID NO: 462153 - DNA, 508 bp, Homo sapiens; identical to SEQ ID NO: 451448
  misc_feature: HEFZJCU01EWCHM.14.85.H08.1.454.heavy.3.raw

SEQ ID NO: 462154 - DNA, 465 bp, Homo sapiens; identical to SEQ ID NO: 460625
  misc_feature: HEFZJCU01CJSKZ.9.30.C08.1.454.heavy.3.raw

SEQ ID NO: 462155 - DNA, 492 bp, Homo sapiens
  misc_feature: HEFZJCU01EXNS3.49.58.F03.1.454.heavy.3.raw
agtcgagagacacgaccggtgctcgatttagtctgatcgagaagggaaagggggcatcatccaacgaccacatcccttctctacagaagcctctgagaggaaagttcttcaccatggactggacctggagggtcttctgcttgctggctgtagctccaggtgctcactcccaggtgcggctggtgcagtctgggtctgaggtgaagaagcctggggcctcagtgaaggtttcctgcaagacatctggatacaccttcaccaactactatatgcactgggtgcgacaggcccctggacaggggcttgagtggatggggataatcaaccctggtatcatctaccctggtcgtagtcagacaacgtacgcgcagaacttccagggcagagtcaccgtgacccagggacacgtccacgagcacagtctatatggagctgagcagcctgagatctgaggacacggccgtgtattactgtgcgagatccaaatactta

SEQ ID NO: 462156 - DNA, 518 bp, Homo sapiens
  misc_feature: HEFZJCU01CNRMJ.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcgtcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcgccctgggctgcctggtcaaggactacttccagacgtatca

SEQ ID NO: 462157 - DNA, 374 bp, Homo sapiens; identical to SEQ ID NO: 444640
  misc_feature: HEFZJCU01BO5HE.7.37.D04.1.454.heavy.3.raw

SEQ ID NO: 462158 - DNA, 508 bp, Homo sapiens
  misc_feature: HEFZJCU01C0MUS.48.81.H04.1.454.heavy.3.raw
agtatacatacacgaccggtgctcgatttagtagtgtagattcgcgggggagcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacggggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcgcggggaggtggacggagctcggttttcggagttatcatctactacttt

SEQ ID NO: 462159 - DNA, 517 bp, Homo sapiens
  misc_feature: HEFZJCU01C5SUN.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgttcttcaaatgaacagcctgagagccgatgacacggccgtgtattactgtgcgagagatggggcccacgaacgttactacgctatggacgtctgggccaagggaccg

SEQ ID NO: 462160 - DNA, 437 bp, Homo sapiens; identical to SEQ ID NO: 444603
  misc_feature: HEFZJCU01EH05L.3.21.B10.1.454.heavy.3.raw

SEQ ID NO: 462161 - DNA, 496 bp, Homo sapiens; identical to SEQ ID NO: 444697
  misc_feature: HEFZJCU01DT01L.16.37.D04.1.454.heavy.3.raw

SEQ ID NO: 462162 - DNA, 500 bp, Homo sapiens; identical to SEQ ID NO: 444529
  misc_feature: HEFZJCU01DJCFW.12.38.D05.1.454.heavy.3.raw

SEQ ID NO: 462163 - DNA, 518 bp, Homo sapiens
  misc_feature: HEFZJCU01C5HPI.3.17.B06.1.454.heavy.3.raw
  modified_base (441)..(441): a, c, t, g, unknown or other
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaatgaacngcctgacgaaccgacgacacggccgtctattattgtgtcatagacctaggatacaacgacggtggtacctggtattc

SEQ ID NO: 462164 - DNA, 488 bp, Homo sapiens
  misc_feature: HEFZJCU01DGSRJ.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccactcggtcttcccctcggcgccctgctccaggagcacctccgagagcacagcgcctggctgcctggtcaaggactacttcccatactcgta

SEQ ID NO: 462165 - DNA, 501 bp, Homo sapiens
  misc_feature: HEFZJCU01DEM45.10.38.D05.1.454.heavy.3.raw
catagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctgggccg

SEQ ID NO: 462166 - DNA, 515 bp, Homo sapiens
  misc_feature: HEFZJCU01EX9D4.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtcgtcggggaccg

SEQ ID NO: 462167 - DNA, 507 bp, Homo sapiens
  misc_feature: HEFZJCU01AEGO3.49.5.A05.1.454.heavy.3.raw
agtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggaggcgtggtccagcctgggacgtccctgagactctcctgtgcagcctctggatttacattcagtagttatgctatgcactggtttcgccagggtccaggcaaggggctggagtgggtggcagttatatcgtatgatggaaacgaaaatactacgcagactccgtgaagggccgattcaccatctcccgacacaattccaagaacacattgtttctactgctgaacagcctgagaagtgacgacacggctgtatatcactgtgcggcaggcaacgattacacccgaaggactactggggccac

SEQ ID NO: 462168 - DNA, 484 bp, Homo sapiens
  misc_feature: HEFZJCU01CPK2R.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctagtcgacgacgacggcatgtattactgtgagagacgttggtggctacgcgggct

SEQ ID NO: 462169 - DNA, 486 bp, Homo sapiens
  misc_feature: HEFZJCU01BBMGB.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccaggggaggcttagttcagcctggggagtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcatt

SEQ ID NO: 462170 - DNA, 408 bp, Homo sapiens; identical to SEQ ID NO: 461901
  misc_feature: HEFZJCU01DYING.49.43.D10.1.454.heavy.3.raw

SEQ ID NO: 462171 - DNA, 487 bp, Homo sapiens; identical to SEQ ID NO: 445219
  misc_feature: HEFZJCU01AW10P.10.85.H08.1.454.heavy.3.raw

SEQ ID NO: 462172 - DNA, 503 bp, Homo sapiens
  misc_feature: HEFZJCU01BM7YB.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccagatccggtgagcctacggcagcggcctttgacttcgtc

SEQ ID NO: 462173 - DNA, 518 bp, Homo sapiens; identical to SEQ ID NO: 459232
  misc_feature: HEFZJCU01APOUW.17.33.C11.1.454.heavy.3.raw

SEQ ID NO: 462174 - DNA, 516 bp, Homo sapiens
  misc_feature: HEFZJCU01EYXV5.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggcctggctgcctggtcaaggactacttccagacgtatca

SEQ ID NO: 462175 - DNA, 502 bp, Homo sapiens
  misc_feature: HEFZJCU01CP0YT.19.86.H09.1.454.heavy.3.raw
tactctcgtgcacgaccggtgctcgatttagtgctatagacttgggtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttccccctggcgccctgctccaggagcacctcccgagagcacagcggccctgggctgcctggtcaaggactacttcccacgagagta

SEQ ID NO: 462176 - DNA, 395 bp, Homo sapiens; identical to SEQ ID NO: 444517
  misc_feature: HEFZJCU01CVBA8.16.68.G02.1.454.heavy.3.raw

SEQ ID NO: 462177 - DNA, 514 bp, Homo sapiens
  misc_feature: HEFZJCU01E0VM7.4.57.F02.1.454.heavy.3.raw
agcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccgagggaaccctggtcaccgtctcctcagcttccaccaagggcccagtcggtcttcccctcggccgccctgctccaggagcacctctgggggcac

SEQ ID NO: 462178 - DNA, 496 bp, Homo sapiens; identical to SEQ ID NO: 446592
  misc_feature: HEFZJCU01C0KDY.4.75.G09.1.454.heavy.3.raw

SEQ ID NO: 462179 - DNA, 512 bp, Homo sapiens
  misc_feature: HEFZJCU01BEN7Y.4.33.C11.1.454.heavy.3.raw
agcactgtagcacgaccggtgctcgatttagagtgagctcggttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctgggagtgggtaggtttcattagagccatggcttatgctgggacaacagaatacgccgcgtctgtgaaggcagattcatcatctcaagagatgattccaacggcatcgcctatctgcagatgaacagcctgaacgaccggaggacacacgccgtctatactgtgttagggtagtttacgtattttggt

SEQ ID NO: 462180 - DNA, 390 bp, Homo sapiens; identical to SEQ ID NO: 444541
  misc_feature: HEFZJCU01B4JU2.16.24.C02.1.454.heavy.3.raw

SEQ ID NO: 462181 - DNA, 501 bp, Homo sapiens
  misc_feature: HEFZJCU01DG4PW.21.19.B08.1.454.heavy.3.raw
tcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtacctatagtatgaattggatccgccaggctccaggaaaggggctggagtggctctcacagattagtggtagtagtagtttcatatattacgcagactcagtgcagggccgattcaccatctccagagacaacgccaagaattccctgtatctgcaaatggacagcctgagagtcgaggacacggctatgtattactgtgcgggtggctggggcgggatgacagctggggccac

SEQ ID NO: 462182 - DNA, 543 bp, Homo sapiens
  misc_feature: HEFZJCU01B7HXJ.52.49.E05.1.454.heavy.3.raw
cgcagtacgacacgaccggtgctcgatttagagcgactagcaacacacaaaggggacccaaaaaccacacccctccttgggagaatcccctagatcacagctcctcaccatggcctggacctggagcatccttttcttggtggcagcagcaacaggtgcccactcccaggttcacctggtgcagtcgggaggtgaggttaagaggcctggggcctcagtgaaggtcgcctgcaaggcttcaggttacaccctttccacgtctggtatcagttgggtgcgacaggcccccggacaagggcttgagtggatgggatggatcagcggtgacaacggcaacacaaattatggacagaagttccagggcagagtcaccatgaccgcggacacatccacgaacacagcctacatggagctgaggagcctaagatctgacgacacggccgtttattactgttgtgagagattttaggggacctcggcccttgggggacgttatcgttactttgactacgtggggccagggaacccaggtcaccgtctccg

SEQ ID NO: 462183 - DNA, 482 bp, Homo sapiens; identical to SEQ ID NO: 444503
  misc_feature: HEFZJCU01E1RTE.7.10.A10.1.454.heavy.3.raw

SEQ ID NO: 462184 - DNA, 524 bp, Homo sapiens; identical to SEQ ID NO: 446418
  misc_feature: HEFZJCU01C8EP5.53.76.G10.1.454.heavy.3.raw

SEQ ID NO: 462185 - DNA, 523 bp, Homo sapiens; identical to SEQ ID NO: 458753
  misc_feature: HEFZJCU01EQ7LV.3.82.H05.1.454.heavy.3.raw

SEQ ID NO: 462186 - DNA, 501 bp, Homo sapiens
  misc_feature: HEFZJCU01BUL1L.12.55.E11.1.454.heavy.3.raw
atacgacgtacacgaccggtgctcgatttagcactcgcacgttgggtttgggctgagctgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggccgcctgctcc

SEQ ID NO: 462187 - DNA, 519 bp, Homo sapiens; identical to SEQ ID NO: 444867
  misc_feature: HEFZJCU01DWPIA.9.34.D01.1.454.heavy.3.raw

SEQ ID NO: 462188 - DNA, 489 bp, Homo sapiens
  misc_feature: HEFZJCU01C3WF5.10.71.G05.1.454.heavy.3.raw
catagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatccta

SEQ ID NO: 462189 - DNA, 516 bp, Homo sapiens
  misc_feature: HEFZJCU01DFP79.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctgggtggacagatcactgggggccaac

SEQ ID NO: 462190 - DNA, 501 bp, Homo sapiens; identical to SEQ ID NO: 457766
  misc_feature: HEFZJCU01BZKN7.11.27.C05.1.454.heavy.3.raw

SEQ ID NO: 462191 - DNA, 525 bp, Homo sapiens
  misc_feature: HEFZJCU01AYJMB.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaatgaataacctgagagccgaggacacggccatgtattactgtgtggggcatttacttgaccctggggccgggaacctggtcaccgtctccccaccctccaccg

SEQ ID NO: 462192 - DNA, 511 bp, Homo sapiens
  misc_feature: HEFZJCU01A3AL9.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggatggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctcaccaaggccc

SEQ ID NO: 462193 - DNA, 528 bp, Homo sapiens
  misc_feature: HEFZJCU01B5DHY.12.40.D07.1.454.heavy.3.raw
atacgacgtacacgaccggtgctcgatttagtgatagagcgtaacaacagagggctcaccatggagtttgggctgagcgtggttttccgtcgttaggctctttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctctggccaatactatgggggcttgtctggggccagggggccctggtcatcgtctccccagcctccaccaagggcccatccggtcttccccctggcgcctcg

SEQ ID NO: 462194 - DNA, 519 bp, Homo sapiens; identical to SEQ ID NO: 445617
  misc_feature: HEFZJCU01BV9OO.9.34.D01.1.454.heavy.3.raw

SEQ ID NO: 462195 - DNA, 521 bp, Homo sapiens
  misc_feature: HEFZJCU01CIGUF.40.20.B09.1.454.heavy.3.raw
tctagcgactcacgaccggtgctcgatttagtgtagtgtgaaggggtctgagagaggagccttagccctggattccaaggcctatccacttggtgatcagcactgagcaccgaggagtcaccatggaactgggactccgctgggttttccttgttgcgattttagaaggtgtcaagtgtgaggtgcgactggtcgagtctgggggaggcctggtcaagccgggggggtccctgagactctcctgcgcagcctctggattcatgtttagtgattattggatggcttgggtccgtcaggctccagggaaagggctggagtttgtggccaagatgaaccacgacggaaatgagaaaaactatgcggactctgtgaagggccgattcaccatttccagagacaacgccaagaagtcactctctctacacatgaccagcctgacagccgaggacacggctgtttattactgtgcgagagatggcactcggggcgtggactttgactactggggccagggctacccg

SEQ ID NO: 462196 - DNA, 538 bp, Homo sapiens; identical to SEQ ID NO: 457765
  misc_feature: HEFZJCU01A1VLG.14.57.F02.1.454.heavy.3.raw

SEQ ID NO: 462197 - DNA, 516 bp, Homo sapiens
  misc_feature: HEFZJCU01AKAVZ.7.71.G05.1.454.heavy.3.raw
cgtgtctctacacgaccggtgctcgatttagtgtcgtcgcaagagagagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaaggggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccgagcgggagttccgaagtactcctttg

SEQ ID NO: 462198 - DNA, 523 bp, Homo sapiens
  misc_feature: HEFZJCU01BHE5R.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccacgcctccaccaagggcccatcggtcttccccctgccg

SEQ ID NO: 462199 - DNA, 516 bp, Homo sapiens
  misc_feature: HEFZJCU01ALSJB.13.36.D03.1.454.heavy.3.raw
tcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaatggggcgcagggctgttgaagccttcggagaccctgtccctcacgtgcgctgtctctggtgggttcttcagtggttactactggagctggatccgccagtccccagggaaggggctggagtggattggggaaatcaatcatagtggaagcaccaactacaacccgtccctcgagagccgagtcaccatgtcagtagacacgtccaagaaccagttctccctgagggtgagctctgtgaccgccgcggacacggctgtgtacttctgtgcgagaggcaatttttggactcgtcattctccctttgactttctggggccagggaaccctagtccaccgttc

SEQ ID NO: 462200 - DNA, 536 bp, Homo sapiens
  misc_feature: HEFZJCU01AIGNQ.51.26.C04.1.454.heavy.3.raw
cgatcgtatacacgaccggtgctcgatttagtctagcgactttgggtttgggctgagcgtggtttccgtcgttaggctcttttaagtaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtctggggccaagggaccacggtcaccgtctccttagcctccaccaagggcccatcggtcttccccctggcaccctcctccaagagcacctctc

SEQ ID NO: 462201 - DNA, 511 bp, Homo sapiens
  misc_feature: HEFZJCU01D55VP.52.82.H05.1.454.heavy.3.raw
cgcagtacgacacgaccggtgctcgatttagtcgagctctctcgcgggcacgaccggtgctcgatttagtcgctgcgtaaaggagaaaggggctctgagagaggagccttagccctggattccaaggcctatccacttggtgatcagcactgagcaccgaggattcaccatggaattggggctccgctgggttttccttgttgctattttagaaggtgtccagtgtgaggtgcagctggtggagtctgggggaggcctggtcaagccggggggtcctgagactctcctgtgcagcctctggattcaccttcagcagttatagcatgaactgggtccgccaggctccagggaaggggctggaggtgggtctcatttattagtactagttacttatactacgcagactcagtgaagggccgattcaccatctccagagacaacgccaggaattcactatatttgcaaatgaacagcctgcgagccgaggaccacgggctggtcgttatttact

SEQ ID NO: 462202 - DNA, 505 bp, Homo sapiens; identical to SEQ ID NO: 447076
  misc_feature: HEFZJCU01EJ40O.10.38.D05.1.454.heavy.3.raw

SEQ ID NO: 462203 - DNA, 492 bp, Homo sapiens
  misc_feature: HEFZJCU01BQ7YX.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggcccgtgggctgcctggtcaaggactacttccgtatctctcg

SEQ ID NO: 462204 - DNA, 500 bp, Homo sapiens
  misc_feature: HEFZJCU01DERTJ.14.12.B01.1.454.heavy.3.raw
cgtctagtaccacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaagggccgattcgccatctccagagacaattccaggaacacgctgtacctggagatggacggcctgagacctgacgacacggcaatttattactgtgcgagggtttatgtgttggaacgtggtacaccggaaaactggttcgacccctggggccagggaaccctggtcgtcgtctcgtctgcctccaccaagggcccatcggtcttcccctggcgccctgctccaggagcacctccgagagcacagcggccctgggctgcctggtcaaggactacttccgtactagacg

SEQ ID NO: 462205 - DNA, 533 bp, Homo sapiens
  misc_feature: HEFZJCU01ECTNG.13.10.A10.1.454.heavy.3.raw
tcacgtactacacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtactgggcacagaggactcaccatggagtttgggctgaggtggtttttccttggtgctattttaaaggtgtccattgtgaagtgcccctggtacaatctgggggaggcttggtcaaggccgggggagtccctgagactctcctgtgaagcctcaacattcacttttgctcgtgcctgggtgacctgggtccgccaggctccagggaaggggctggagtggattgaccatattaaggacagacctaatggcgcgacagcacactaccttgaatccgtacaaagacagattcatcatctcgagaggtgattccgacaacacggtgtctctccatatgagcagcctagaaaatcgaaggacacaggcctatatta

SEQ ID NO: 462206 - DNA, 517 bp, Homo sapiens
  misc_feature: HEFZJCU01ASXIE.49.33.C11.1.454.heavy.3.raw
agtcgagagacacgaccggtgctcgatttagagtgagctcgttgggtttggggttgaagtgaagaagcctggggcctcggtgaaggtttcctgcaaggcatctggatacagcttgaccaactactatatacagtgggtgcgacaggcccctggacaagggcttgagtggatgggaagaatcaaccctaatgatggaagtacaacaaacgcgcagaaatttcagggcagaataaccctgaccagggacacgtccacgagcacagtctacatggaattgagcagcctgagatctgaagacacggccgtctattactgtgccagagaatatcgttttatagtgggagctgccccacgatcgccattccactttgactactggggccagggaacactggtcaccgtctcctcagcctccaccaaggcccatcggtcttcccctggcaccctcctccaagagcacctctgggggcacagcggccctgggctgcctggtcaaggactacttcctctctcgact

SEQ ID NO: 462207 - DNA, 509 bp, Homo sapiens; identical to SEQ ID NO: 453913
  misc_feature: HEFZJCU01DA1TQ.22.82.H05.1.454.heavy.3.raw

SEQ ID NO: 462208 - DNA, 490 bp, Homo sapiens
  misc_feature: HEFZJCU01DV24L.49.32.C10.1.454.heavy.3.raw
agtcgagagacacgaccggtgctcgatttagtatagacatcaacacacaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatgtcatatgatggaagtaatatatactatatagactccgtgaagggccgattcatcatctccagagacaattccgagaacacgctgtatctgcaaatgaacagcctgagagttgaggacacggctgtgtattattgtgcgaacttaatcacgga

SEQ ID NO: 462209 - DNA, 513 bp, Homo sapiens
  misc_feature: HEFZJCU01EF8K7.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggcttggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagacgccgacgacacggctatctattactgtgcgaaactctcattccttcatctgaatacgtgggccagggaacccctggtccgtccg

SEQ ID NO: 462210 - DNA, 495 bp, Homo sapiens
  misc_feature: HEFZJCU01EQEM4.13.11.A11.1.454.heavy.3.raw
tcacgtactacacgaccggtgctcgatttagctacgactgcaggggtctgggagaggagccccagccctgagattcccaggtgtttccattcagtgatcagcgactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcatctttgatgattatgccatgcactgggtccggcaagctccagggaagggcctggagtgggtctcaggtattagttggaatagtggtaacataggctatgcggactctgtgaagggccgattcaccatctccagagacaacgccaagaactccctgtatctgcaaatgaacagtctgagagctgaggacacggccttgtattactgtgcaaaaggtccatttagcagtggctc

SEQ ID NO: 462211 - DNA, 395 bp, Homo sapiens; identical to SEQ ID NO: 444494
  misc_feature: HEFZJCU01ETLGF.47.46.E02.1.454.heavy.3.raw

SEQ ID NO: 462212 - DNA, 500 bp, Homo sapiens
  misc_feature: HEFZJCU01DOADJ.10.23.C01.1.454.heavy.3.raw
catagtagtgcacgaccggtgctcgatttagtacacgtgattagggattgggaggcttggtacagcctggcaggtccctgagactctcctgtgcagcctctggattcagctttgatgaatatgccatggactgggtccggcaagttccagggaagggcctggagtgggtctcaggtattgattggaatagtggtaccattgcctatgcggactctgtgaagggccgattcaccatcaccagagacgacgccaggagctccctgtatctccaaatgaacagtctgagacctgaggacacggccttgtattactgtgtaagagggagtcagggtttcaactattatagtagtggttatgactactggggccagggaaccctggtcaccgtctcctcagcctccaccaagggcccatcggtcttcccctggcgccctgctccaggagcacctccgagagcacagcggcctgggctgcctggtcaaggactactcccactacta

SEQ ID NO: 462213 - DNA, 517 bp, Homo sapiens; identical to SEQ ID NO: 444897
  misc_feature: HEFZJCU01ATQFZ.9.34.D01.1.454.heavy.3.raw

SEQ ID NO: 462214 - DNA, 511 bp, Homo sapiens
  misc_feature: HEFZJCU01DYDUL.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagcgtgcgttttctaggtggctaattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgagacacggccatatattactgtgcgaaagcaccggcagttagcacccatactactttgacttactggggccg

SEQ ID NO: 462215 - DNA, 514 bp, Homo sapiens; identical to SEQ ID NO: 449858
  misc_feature: HEFZJCU01CIS6K.19.67.G01.1.454.heavy.3.raw

SEQ ID NO: 462216 - DNA, 384 bp, Homo sapiens; identical to SEQ ID NO: 444454
  misc_feature: HEFZJCU01CX5RL.11.61.F06.1.454.heavy.3.raw

SEQ ID NO: 462217 - DNA, 505 bp, Homo sapiens
  misc_feature: HEFZJCU01CU9MJ.49.21.B10.1.454.heavy.3.raw
agtcgagagacacgaccggtgctcgatttagtgtcgtcgcaaggggctgggagacgagcccagcactggaaggcgccggtgtttccattcggtaatcagcactgaacacagaggactcaccatggagtttgggctgagctgggttttcctcgttggtcttttaagaggtgtccagtgttatgtgcagttggtggagtctgggggaggcgtggtccagcctgggaagtcactgagactcgcctgtacaccctctggattcaccttcagcaactatgcaatgcactgggtccgcctggctcccggcaagggtctggactgggtggcaggtatatcagctgatgggaccaaaatatactacgcaaactccgtgaagggccgattccaccatatcaagagacacttccgatgacacatctatctgcaaatgaacagcctgaaagttgacgacacgggtctttttactgtgcgcctaggaagcagtggctggccacatgatgtcttttga

SEQ ID NO: 462218 - DNA, 392 bp, Homo sapiens
  misc_feature: HEFZJCU01EWRWD.16.70.G04.1.454.heavy.3.raw
tgtactactccacgaccggtgctcgatttagtgtagtgtgaagggaaggggctggagtggatcgggaatatctattatagtgggagcacctactacaacccgtccctcaagagtcgagtcgccatatccgtagacacgtccaagaaccacttctccctgaaactgagctctgtgaccgccgcagacacggctgtctattactgtgcgagacagagttacgacggtggttactccggtctctttgacaactggggccagggaaccctggtcaccgtctcctcagcctccaccaagggcccatcggtcttccccctggcgccctgctccaggagcacctccgagagcacagcggccctgggctgcctggtcaaggactacttccgagtagtaca

SEQ ID NO: 462219 - DNA, 495 bp, Homo sapiens
  misc_feature: HEFZJCU01CUGWG.53.56.F01.1.454.heavy.3.raw
cgcgtatacacacgaccggtgctcgatttagcagacgtctgaacacacaaagggggagcatcacccagcaaccacatctgtcctccagagaatcccctgagagctccgttcctcaccatggactggacctggaggatcctcttcttggtggcagcagccacaggagcccactcccaggtgaaattgctgcagtctggggctgaggtgaagaagcctggggcctcagtgaaggtctcctgcaagacttctggatacatcttcaccgactactatgttcactgggtgcgacaggcccctggacaaggacttgagtggatgggatgggttcaaccctgacactggtgtcgcaacctatgcacagaggtttcaggggcagggtcaccatgaccagggacacgtccatcagcacagcctacatggagctacacggcctgagatctgacgacacgggccctcggtatttttgtggtcgagagagtctatttaaagtggctt

SEQ ID NO: 462220 - DNA, 530 bp, Homo sapiens
  misc_feature: HEFZJCU01BI8YM.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagaggggagagtggagtagaacgtaaatacgggaaaccgtttgacttttgggccagggaaccctggtcaccgtctcctcagcctccaccaagggcccatcggtcttcccctggcaccctcctccaagagcacctctgggggcacagcggccctgggcctgcct

SEQ ID NO: 462221 - DNA, 395 bp, Homo sapiens; identical to SEQ ID NO: 445227
  misc_feature: HEFZJCU01EM42G.47.46.E02.1.454.heavy.3.raw

SEQ ID NO: 462222 - DNA, 516 bp, Homo sapiens
  misc_feature: HEFZJCU01DLDYT.17.33.C11.1.454.heavy.3.raw
  modified_base (490)..(490): a, c, t, g, unknown or other
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaccaggtggtccttacaatgaccaatatggaccctgtggacacagccacatattactgttcacgctctatggttcggggagttattagtccctactttgactactggggccagggaactctggtcaccgtcnccgcagcctccaccaagggcccatcc

SEQ ID NO: 462223 - DNA, 503 bp, Homo sapiens
  misc_feature: HEFZJCU01BD6CX.52.70.G04.1.454.heavy.3.raw
cgcagtacgacacgaccggtgctcgatttagtgtagtgtgaagggaaaggggacccaacaaccacatccctcctcagaagccccagagcacaacgcctcaccatggactggacctggaggatcctctttttggtggcagcagccacaggtgcccactcccaggtccaaattgtgcagtctggggctgaggtgaagaagcctggggcctcagtgaaggtttcctgcaaggcttctggatacagtttcactaggtattcgatgcattggctgcgccaggcccccggacaaaggcctgagtggatgggaagtctcagtgatggcaaaggtgacaaaaagtattcacagaagttccagggcagagtcaccattaccagcgacgcatccgcgaacacagcctatatggaactcagcagcctgagatctgaagacacggctgtctattactgtgcgagggtcggcacgctgacaacctcttacttctatttcctacgctatgacgtctc

SEQ ID NO: 462224 - DNA, 510 bp, Homo sapiens
  misc_feature: HEFZJCU01DWW8Y.4.81.H04.1.454.heavy.3.raw
agcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtctgggggaggcctggtcaaacctggggggtccctgagactctcgtgtgtagtctctgaattcatcttcagggactttgacatgaattgggtccgccaggctccagggaagggctggagtgggtctcatccatcagttccagtactcgttacatatactacgcagactcagtgaggggccgattcaccatctccagagacaacgccaagaactcagtgtttctgcaaatgaacagcctgagagtcgaggactcgggctgtctactactgtgcgaggaataagggagctacctacgatttggactacg

SEQ ID NO: 462225 - DNA, 507 bp, Homo sapiens
  misc_feature: HEFZJCU01EG2ZB.40.75.G09.1.454.heavy.3.raw
tctagcgactcacgaccggtgctcgatttagtatagacatcaggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgtatgccttttgatatgtgggggtccgaaggggacaaacgtggtctaccg

SEQ ID NO: 462226 - DNA, 492 bp, Homo sapiens
  misc_feature: HEFZJCU01EWK7T.48.73.G07.1.454.heavy.3.raw
agtatacatacacgaccggtgctcgatttagctctacgctcagggcacgaccggtgctcgatttagagtgagctcgttgggtttggggacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttatggtggataaagccacgagcacagtctacatgcagctgagcagcctgagacacaacgacacggccgtctattattgttacc

SEQ ID NO: 462227 - DNA, 508 bp, Homo sapiens
  misc_feature: HEFZJCU01B7XRH.9.14.B03.1.454.heavy.3.raw
tgatacgtctcacgaccggtgctcgatttagtgtgagtagtttgggtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacacctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctgggctgcctggtcaaggactacttccagacgtatca

SEQ ID NO: 462228 - DNA, 521 bp, Homo sapiens
  misc_feature: HEFZJCU01EDRXU.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtcccttactttgactactggggccaggggaactctggtcaccgtctccgcagcctccaccaacgggcccagtcc

SEQ ID NO: 462229 - DNA, 534 bp, Homo sapiens
  misc_feature: HEFZJCU01BSBDE.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagcccgcggacacgggcgtttattactgtgcgagagggacggacgtacggtgactacgtgggggtttccgaccccgtggggccagggaaccctggtcaccgtctcctcacgcctccaaccg

SEQ ID NO: 462230 - DNA, 504 bp, Homo sapiens; identical to SEQ ID NO: 445696
  misc_feature: HEFZJCU01ELDNF.10.38.D05.1.454.heavy.3.raw

SEQ ID NO: 462231 - DNA, 508 bp, Homo sapiens
  misc_feature: HEFZJCU01CPUJC.3.17.B06.1.454.heavy.3.raw
agacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctggggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtgtcatagacctaggatacaacgac

SEQ ID NO: 462232 - DNA, 511 bp, Homo sapiens
  misc_feature: HEFZJCU01DZ6O7.48.19.B08.1.454.heavy.3.raw
  modified_base (508)..(508): a, c, t, g, unknown or other
agtatacatacacgaccggtgctcgatttagtgagtcagtaagggggctttctgagagtcatggatctcatgtgcaagaaaatgaagcacctgtggttcttcctcctcctggtggcggctcccagatgggtcctgtcccagctgcagctgcaggagtcgggcccaggactggtgaagccttcggagaccctgtccctcacctgcactgtctctggtgactccatcagcagtagtacttactactggggctggatccgccagcccccagggaaggggctggagtggattgggagtatctattatagtgggagtacctactacaacccgtcctcaagagtcgactcaccatatccgtagacacgtccaagaaccagttctccctgaagctgagctctgtgaccgccgcagacacggctgtgtattactgtgcgagggggccgggatattgttaatagaaccacctgctatctgagctggttcgactgctggggccagggaaccctggtcnccg

SEQ ID NO: 462233 - DNA, 531 bp, Homo sapiens
  misc_feature: HEFZJCU01C0F2K.49.46.E02.1.454.heavy.3.raw
agtcgagagacacgaccggtgctcgatttagactcatctacagggaaaggggggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatgagcagtagtaattactactggggctgggtccgccagcccccagggaaggggcttgagtggattgggagtatatattttactgggacgtcctactacaacccgtccctcaagagtcgagtcaccatatcagaagacacatccaagaaccaattcctccttgaagctgacctctgtgaccgccgcggacacggccgtgtattactgtggagttccagctgtcggatactactactactacggtgtggacgtctggggccaagggaccacggtcaccgtctcctcagcctccaccaagggcccatcggtcttcccctgg

SEQ ID NO: 462234 - DNA, 479 bp, Homo sapiens
  misc_feature: HEFZJCU01A1WXC.15.38.D05.1.454.heavy.3.raw
tctacgtagccacgaccggtgctcgatttagtatctgatagttgggtccctgagactcccctgtgtagcctctggattcaccttcagaggcttttggatgagttgggtccgccaggctccagggaaggggctggagtgggtggccaacataaaccaagatggaagtgaagagtactatgtggactctgtgaagggccgcttcaccatttccagagacaacgccaagaactctctgtttctgcaaatgaacagtctgagagccgaggacacggctgtctattactgtgcgagaacccgtagagatgggtacaaaagggaggggacttactttgactactgggccggggaaccctggtcaccgtctcctcagcctccaccaagggcccatcggtcttccccctggcaccctcctccaagagcacctctgggggcacagcggccctgggctgcctggtcaaggactacttccgctacgtaga

SEQ ID NO: 462235 - DNA, 484 bp, Homo sapiens
  misc_feature: HEFZJCU01EIVQ6.51.38.D05.1.454.heavy.3.raw
  modified_base (247)..(247): a, c, t, g, unknown or other
cgatcgtatacacgaccggtgctcgatttagtatctgatagttgggtttgggcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtaaaccgtccggattcaccttcagtaactatgcaatgcactgggtccnccaggctccaggcaaggggctggactggggtggcaggcatatcatttgatggaagcaagaagtactatgcagactccgtgaagggccgattcaccatctccagagacagttccgatgacacagtctatctacacatgagcagtgtgagacctgacgacacggctctttttactgtgcgccaggaagcagtggctggccacatcatgcttttgatatctggagccaagggacaatggt

SEQ ID NO: 462236 - DNA, 508 bp, Homo sapiens
  misc_feature: HEFZJCU01ER9X8.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgacgcctacggcaggcggtcctttgactttcgtc

SEQ ID NO: 462237 - DNA, 525 bp, Homo sapiens
  misc_feature: HEFZJCU01BZYAH.13.33.C11.1.454.heavy.3.raw
tcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacggcaaatatggttcaggggagttcgactactggggccagggaaccctggtccaccggtctcctcacgcctccaccaaggg

SEQ ID NO: 462238 - DNA, 524 bp, Homo sapiens
  misc_feature: HEFZJCU01CIWC2.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacgggccgtctatttactgtgcggagacgtcccaacgactcccgggtgacgccctacgggccaggccgggtccttttggacctttcgtc

SEQ ID NO: 462239 - DNA, 398 bp, Homo sapiens
  misc_feature: HEFZJCU01D95X8.4.60.F05.1.454.heavy.3.raw
agcactgtagcacgaccggtgctcgatttagtacgtcatcagggaaaggggctggagtgggtctccactattagtggtagtggtggtagtacatcctatgcagactccgtgaagggccggttcaccatctccagagacaatgccaagaacacggtgtatgtgcaagtgaccagcctgagagtcgaggacacggccgtgtattactgtgcgaaggcctttgccccaaacgtggatatagtggctaactttgactactggggccagggaaccctggtcgccgtctcctcagcctccaccaagggcccatcggtcttccccctggcgccctgctccaggagcacctccgagagcacagcggccctgggctgcctggtcaaggactacttccctacagtgct

SEQ ID NO: 462240 - DNA, 510 bp, Homo sapiens; identical to SEQ ID NO: 453756
  misc_feature: HEFZJCU01AHLOX.47.55.E11.1.454.heavy.3.raw

SEQ ID NO: 462241 - DNA, 505 bp, Homo sapiens; identical to SEQ ID NO: 450152
  misc_feature: HEFZJCU01A5W66.51.71.G05.1.454.heavy.3.raw

SEQ ID NO: 462242 - DNA, 494 bp, Homo sapiens; identical to SEQ ID NO: 445975
  misc_feature: HEFZJCU01BOB11.48.70.G04.1.454.heavy.3.raw

SEQ ID NO: 462243 - DNA, 534 bp, Homo sapiens
  misc_feature: HEFZJCU01BXWWD.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagtttacgtggactctgtgaagggccgtttcaccatctccagagacaacgccaagaattcactgtatctacaactgaacagcctgagagtcgcagacacggccgtgtattactgtgcgagatgtggaaaagtaatggctgtgtttattggggccagggagccctggtctaccg

SEQ ID NO: 462244 - DNA, 395 bp, Homo sapiens; identical to SEQ ID NO: 447960
  misc_feature: HEFZJCU01EQ9B0.10.42.D09.1.454.heavy.3.raw

SEQ ID NO: 462245 - DNA, 316 bp, Homo sapiens; identical to SEQ ID NO: 444479
  misc_feature: HEFZJCU01CKUMR.47.84.H07.1.454.heavy.3.raw

SEQ ID NO: 462246 - DNA, 500 bp, Homo sapiens; identical to SEQ ID NO: 445807
  misc_feature: HEFZJCU01C56JI.40.81.H04.1.454.heavy.3.raw

SEQ ID NO: 462247 - DNA, 499 bp, Homo sapiens; identical to SEQ ID NO: 459138
  misc_feature: HEFZJCU01C6SW2.11.57.F02.1.454.heavy.3.raw

SEQ ID NO: 462248 - DNA, 501 bp, Homo sapiens
  misc_feature: HEFZJCU01BJIPU.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagttttgggctgagcgtggtttcctcgttagcgtcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacggggtcgtttattactgtggggagaaatccctagtggc

SEQ ID NO: 462249 - DNA, 482 bp, Homo sapiens; identical to SEQ ID NO: 445068
  misc_feature: HEFZJCU01AG1XE.11.23.C01.1.454.heavy.3.raw

SEQ ID NO: 462250 - DNA, 513 bp, Homo sapiens; identical to SEQ ID NO: 446699
  misc_feature: HEFZJCU01C5T6D.12.25.C03.1.454.heavy.3.raw

SEQ ID NO: 462251 - DNA, 495 bp, Homo sapiens
  misc_feature: HEFZJCU01A6WEK.13.86.H09.1.454.heavy.3.raw
tcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacagactatggacagaacctccagggcagattcaccatgacgacagacacatacacgaacacagcctacatggaggtgaggagcctgagatatgacgacacggccgtgtattattgtgcgagagtggagtggcaggtggatatcgacaaattactactta

SEQ ID NO: 462252 - DNA, 523 bp, Homo sapiens
  misc_feature: HEFZJCU01AKOYA.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccacgcctccaccaagggcccatcggtcttcccctggccg

SEQ ID NO: 462253 - DNA, 534 bp, Homo sapiens; identical to SEQ ID NO: 457749
  misc_feature: HEFZJCU01BY4ZF.14.26.C04.1.454.heavy.3.raw

SEQ ID NO: 462254 - DNA, 514 bp, Homo sapiens
  misc_feature: HEFZJCU01B1PD6.52.22.B11.1.454.heavy.3.raw
cgcagtacgacacgaccggtgctcgatttagacgacagctcaggggctgggagaggagccccagccgtgagattcccaggagattccacttggtgatcagcactgaacacagacctccaaccatggagtttgggcttagctgcgttttccttgttgctattttaaaaggtgtccaatgtgaggtgcagctggttgagtctgggggaggcttggtacagccagggcggtccctgagactctcctgtgtaacctcaggattcatgtttggtgattatggaatgacctgggtccgccaggctccaggggagggcctggagtgggtagctttcgttagcagaaagactgaaggtgggacaacagaatacgccgcgtctgtgaaaggcagatttatcatctcaagagacgattccaaaggcatcgcctatctgcaaatgaacagcctgaaaccgaggacacagccgtgtatttttgtactagagtcttcttgtattactatgatactagtggttttaca

SEQ ID NO: 462255 - DNA, 503 bp, Homo sapiens
  misc_feature: HEFZJCU01CI468.4.58.F03.1.454.heavy.3.raw
agcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaaagccttgagtggatgggatcgatcaactctggcaatggcaacacaaaatattcacagaagttacagggcagagtcaccattaccagggacacatccgcgaacacagcctacatggagctgagcagcctgacatctgaagacacggctgtgtattactgttcgagacgggctagtctggggatctagtttatatgactcgtcgttctggggccg

SEQ ID NO: 462256 - DNA, 407 bp, Homo sapiens
  misc_feature: HEFZJCU01EZUXN.11.67.G01.1.454.heavy.3.raw
cgagagataccacgaccggtgctcgatttagagtatacatattgggtctcggctattaatggccacggtgacaagacatactacgcagagtccgtgcagggccgatgcaccatctccagagacaattcccaaaagacgctgtacctgcaaatggacagcctgagagccgacgacacggccgtatattactgtgccagaaatccgtccagatattgcactggtggcaactgctacgacgcctactattatcaccacatggacgtctggggcaaagggaccacggtcatcgtctcctcagcctccaccaagggcccatcggtcttccccctggcaccctcctccaagagcacctctgggggcacagcggccctgggctgcctggtcaaggactacttccgtatctctcg

SEQ ID NO: 462257 - DNA, 511 bp, Homo sapiens
  misc_feature: HEFZJCU01CJTF6.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaagggaggggggaaccgagcgggagtccaagtactccttt

SEQ ID NO: 462258 - DNA, 503 bp, Homo sapiens
  misc_feature: HEFZJCU01B9BF5.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaaggggacaa

SEQ ID NO: 462259 - DNA, 505 bp, Homo sapiens
  misc_feature: HEFZJCU01EE7OK.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaagggctggagtgggtctcagttattgaaacagatggcactacatattattctgactccgtgaagggccggttcaccctctccagagacacttccaacaacatcttgtatcttcacatgcacaatctgagagtcgacgacacggccacctattattatgcgcgacatgactacgctcaattctggggccagggacg

SEQ ID NO: 462260 - DNA, 513 bp, Homo sapiens; identical to SEQ ID NO: 445134
  misc_feature: HEFZJCU01B5HBL.3.34.D01.1.454.heavy.3.raw

SEQ ID NO: 462261 - DNA, 510 bp, Homo sapiens; identical to SEQ ID NO: 453756
  misc_feature: HEFZJCU01C447I.47.55.E11.1.454.heavy.3.raw

SEQ ID NO: 462262 - DNA, 497 bp, Homo sapiens
  misc_feature: HEFZJCU01CISJU.10.71.G05.1.454.heavy.3.raw
catagtagtgcacgaccggtgctcgatttagtgtcgtcgcaagagagaggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatcctagtggcatcacctggtattgtgacttccggggccagggaaccgtggtcaccgtctcttcggcctccaccaagggcccatcggtcttcccctggcgccctgctccacggagcacctccgacgaggcacagcggccctcgggctgcctggtcaaggactacttcccactactatg

SEQ ID NO: 462263 - DNA, 518 bp, Homo sapiens
  misc_feature: HEFZJCU01EK84B.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactggggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggcccatcggtcttcccctggcaccctcctccaagagcacctctgggggcacagcggccctggctgcctggtcaaggactacttcctagagacacg

SEQ ID NO: 462264 - DNA, 477 bp, Homo sapiens; identical to SEQ ID NO: 444659
  misc_feature: HEFZJCU01AL8LX.16.10.A10.1.454.heavy.3.raw

SEQ ID NO: 462265 - DNA, 511 bp, Homo sapiens
  misc_feature: HEFZJCU01BTTDR.10.12.B01.1.454.heavy.3.raw
catagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatctgggggaggcgtggtccagccagggaggtccctgagactctcctgtgcagcctctggattgaggttcaataactatgctatgcactgggtccgccaggctccgagggaaggggctggaatggatgacagttatttcacacgatgcaaccaaaacatactacgcggagttcgtgaggggccgctgcatcgtctccagagacaattcgaagaacactctgtacctgcaaatgaacagtctgagagccgaggacacggccgtctacttttgtgcgactagaagtgggagcgtagtaggggtatttgattccg

SEQ ID NO: 462266 - DNA, 502 bp, Homo sapiens
  misc_feature: HEFZJCU01CCH8A.51.78.H01.1.454.heavy.3.raw
cgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggattttccttttggctattttaaaaggtgtccagtgtgaagtgctactggtggagtctgggggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgacaaagccaaggcaacagctggta

SEQ ID NO: 462267 - DNA, 546 bp, Homo sapiens
  misc_feature: HEFZJCU01D2EMD.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaatgaataacctgagagccgaggacacggccatgtattactgtggtgggggcatttacttcgaccccgttgggggccgggggaacccgtgggtaccaccgttcctcccccacccctcccaacccg

SEQ ID NO: 462268 - DNA, 497 bp, Homo sapiens
  misc_feature: HEFZJCU01D7ME9.49.38.D05.1.454.heavy.3.raw
agtcgagagacacgaccggtgctcgatttagtatctgatagttgggtttggggggaagaggaagactgacggtcctcccaggagttcaggtgctgggcaccgtgggcctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctggggccagggagccctggtcaccgtctcctcagcttccaccaagggcccatcggtcttcccctggcgcc

SEQ ID NO: 462269 - DNA, 481 bp, Homo sapiens
  misc_feature: HEFZJCU01CRMMQ.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaaggactgctggggccagggagcccttgtcaccgtctcctcagcctccaccaagggcccatcggtcttcccctggcgccctgctccagagcacctccgagagcacagcggccctgggctgcctggtcaaggactacttcccactactatg

SEQ ID NO: 462270 - DNA, 511 bp, Homo sapiens
  misc_feature: HEFZJCU01C33NI.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgccgtggggccaagggaccacggtcatcgtctccgcagcctccaccaagggcccatcggtcttcccctggcaccctcctccagagcacctctgggggcacagcgccctgggctgcctggtcaaggactacttccgagtgcgtct

SEQ ID NO: 462271 - DNA, 507 bp, Homo sapiens
  misc_feature: HEFZJCU01BRCFX.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaaggccgattcaccatctccagagacaattccaggaacacaatgtatttggagctgaacagcctaagtcctgaggacacggcgtatactactgtacgaaggagggggaacagcgggagttcagtactcttgtacg

SEQ ID NO: 462272 - DNA, 484 bp, Homo sapiens
  misc_feature: HEFZJCU01EKVB6.11.71.G05.1.454.heavy.3.raw
cgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaag

SEQ ID NO: 462273 - DNA, 495 bp, Homo sapiens
  misc_feature: HEFZJCU01DONVH.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctgggccgtggcaccctgctgactgtctcctcagcctccaccaagggcccatcggtcttcccctggcgccctgctccaggagcacctccgagagcacagcggccctggctgcctggtcaaggactacc

SEQ ID NO: 462274 - DNA, 520 bp, Homo sapiens
  misc_feature: HEFZJCU01EBUOF.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaaggcccatcggtcttcccctggcg

SEQ ID NO: 462275 - DNA, 508 bp, Homo sapiens; identical to SEQ ID NO: 445594
  misc_feature: HEFZJCU01E1SA6.17.25.C03.1.454.heavy.3.raw

SEQ ID NO: 462276 - DNA, 522 bp, Homo sapiens
  misc_feature: HEFZJCU01C8MVX.16.86.H09.1.454.heavy.3.raw
  modified_base (516)..(516): a, c, t, g, unknown or other
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccactaggtttgactactggggccaggggaagcttggtcaccgtctcctnacgcct

SEQ ID NO: 462277 - DNA, 532 bp, Homo sapiens
  misc_feature: HEFZJCU01A1LPN.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcctttttactacctcccttcgacttctggggccatggaaccccggtccg

SEQ ID NO: 462278 - DNA, 379 bp, Homo sapiens; identical to SEQ ID NO: 444773
  misc_feature: HEFZJCU01BK1F7.3.59.F04.1.454.heavy.3.raw

SEQ ID NO: 462279 - DNA, 462 bp, Homo sapiens
  misc_feature: HEFZJCU01ACMET.48.79.H02.1.454.heavy.3.raw
agtatacatacacgaccggtgctcgatttagtgtcacacgaagggaaaggggcaagggcgccagatggtccttcctcgtgagtcccaggaccaccctcggcctctggggtccagagtccaacaacccccgggccctccccggcctcaacctgagagagattcccagggacgttttccctggggtcctgacattgttgtcacaatgtgacaactgagtcgacccctggggccagagaaccctggtcaccgtctcctcagggtgaggatggacatttccgccactgtgatcacttccactactgcggtatggacgtctggggccaagggaccacggtcaccgtctcctccagcttccaccaagggtcccatcggtcttccccctggcgccctgctccaggagcacctctgggggcacagcggccctgggctgcctggtccaagggactacttcctatgtatact

SEQ ID NO: 462280 - DNA, 506 bp, Homo sapiens; identical to SEQ ID NO: 445682
  misc_feature: HEFZJCU01BEX33.48.44.D11.1.454.heavy.3.raw

SEQ ID NO: 462281 - DNA, 521 bp, Homo sapiens
  misc_feature: HEFZJCU01AT2G7.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaacgggccgattaaccatctccagagacgattccgagaacacggtgtatcttcaaatgaacaacctgagagccgacgacacggccgtttattactgtgcgagagattcgagtggttcggggacctcaccctggttctacttcgatctcgtc

SEQ ID NO: 462282 - DNA, 507 bp, Homo sapiens
  misc_feature: HEFZJCU01DXGN0.2.16.B05.1.454.heavy.3.raw
  modified_base (498)..(498): a, c, t, g, unknown or other
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagactatgtggactctgtgaagggccgattcaccatctccagagacaacgccaagaactcactgtatctgcaaatgaacagcctaagacccgaggacacggctgtgtattactgtgcgagagaccgctactggggcccggngcccctggt

SEQ ID NO: 462283 - DNA, 501 bp, Homo sapiens
  misc_feature: HEFZJCU01EXSST.40.81.H04.1.454.heavy.3.raw
tctagcgactcacgaccggtgctcgatttagtagtgtagattcgcgggggcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccacgtggggccgac

SEQ ID NO: 462284 - DNA, 508 bp, Homo sapiens; identical to SEQ ID NO: 448191
  misc_feature: HEFZJCU01BYY4R.4.67.G01.1.454.heavy.3.raw

SEQ ID NO: 462285 - DNA, 507 bp, Homo sapiens
  misc_feature: HEFZJCU01B8W9O.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgattactgtgcgagagatcgacatgactacgggaaagcttttgatctctggggccaagggacactggtcaccgtctcttcagcctccaccaagggcccatcggtctccccctggcgccctgctccaggacg

SEQ ID NO: 462286 - DNA, 516 bp, Homo sapiens
  misc_feature: HEFZJCU01CP3RH.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtcgtggggaccg

SEQ ID NO: 462287 - DNA, 513 bp, Homo sapiens
  misc_feature: HEFZJCU01CRTKC.4.23.C01.1.454.heavy.3.raw
agcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatgcacagacgttccagggcagagtcaccattaccacagacacatccacgagcacagcctacatggacctgaggagcctgagatttgacgacacggcccatatattactgtgcgagagattgggccgacgggaaaccttgactactggggccagggaaccctggtcaccgt

SEQ ID NO: 462288 - DNA, 491 bp, Homo sapiens
  misc_feature: HEFZJCU01DDJFO.53.15.B04.1.454.heavy.3.raw
  modified_base (445)..(445): a, c, t, g, unknown or other
cgcgtatacacacgaccggtgctcgatttagacagtatatatccgcgggggctctgggagaggagcccagcactagaagtcggcggtgtttccattcggtgatcagcactgaacacagaggactcagcatggagtttgggctgagctgggttttcctcgttgctcttttaagaggtgtccagtgtcaggtgcaactggtggagtctgggggaggcgtggtccagcctgggaagtcactgcgactctcctgtgcagcctctggattcagcttcagctcgtatgcgatgcactgggtccgccaggctccaggcaaggggctggagtgggtggcggttatttcacatgatggaagtcaggaatattatgcagactccgtgaggggccgattcaccatctcccgagacaattccaagacacagtggatctgacaatgagtagcatgagnggttggggacacgggcggtgtatttactgtgcgaaggctttggctt

SEQ ID NO: 462289 - DNA, 503 bp, Homo sapiens
  misc_feature: HEFZJCU01B3AQ8.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaatttgataggctctatggactggactttcgtc

SEQ ID NO: 462290 - DNA, 495 bp, Homo sapiens
  misc_feature: HEFZJCU01EL2YK.40.81.H04.1.454.heavy.3.raw
tctagcgactcacgaccggtgctcgatttagtagtgtagattcgcggggatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggagagacgttggtggctaccgcggggcgtgaccactggggcc

SEQ ID NO: 462291 - DNA, 505 bp, Homo sapiens
  misc_feature: HEFZJCU01C2FSF.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtctgggggaggcttagttcagcctggggagtccctgagactctcctgtgtagtctctggaatcagtttcagtaccttctggatgcactgggtctgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggtccg

SEQ ID NO: 462292 - DNA, 508 bp, Homo sapiens
  misc_feature: HEFZJCU01E0NUI.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactgggccagggcaccctggtcaccgtctcctcagcttccaccaagggcccatcggtcttcccctggcgccctgctccagagcacctctgggggcacagcggccctgggctgcctggtcaaggactacttccata

SEQ ID NO: 462293 - DNA, 490 bp, Homo sapiens
  misc_feature: HEFZJCU01C20GS.10.29.C07.1.454.heavy.3.raw
catagtagtgcacgaccggtgctcgatttagagtgctacgaagggaaaggggctgggagaggagcccagcactagaagtcggcggtgtttccattcggtgatcagcactgaacacagaggactcaccatggagtttgggctgagcgtgggttttcctcgttgctcttttaagaggtgtccagtgtcaggtgcagctggtggagtctgggggaggcgtggtccagcctggggaggtccctgagactctcctgtgcagcctctggaatccccttcagtacctatggcatgcactgggtccgccaggctccaggcaaggggctggagtgggtggcagccatatcgtatgatgtaactaataaatactatgcagactccgtgaagggccgattcaccatctccagagacaatttcaagaacacgctgtttctgcaaatgaacagcctgagagctgagacacggctgtgtattactgtgcgaagatatcgcgtga

SEQ ID NO: 462294 - DNA, 534 bp, Homo sapiens
  misc_feature: HEFZJCU01AYLXS.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattcccccttcagtagttattggatgacttgggtccgccagactccagggaagggctggagtgggtggccaacgataaagcaagatggaactgccgagtttacgtggactctgtgaagggccgtttcaccatctccagagacaacgccaagaattcactgtatctacaactgaacagcctgagagtcgcagacacggccgtgtattactgtgcgagatgtaggaaaagtatggctgtgtttatggggccagggagccgtggtctaccg

SEQ ID NO: 462295 - DNA, 529 bp, Homo sapiens
  misc_feature: HEFZJCU01B64SN.49.71.G05.1.454.heavy.3.raw
agtcgagagacacgaccggtgctcgatttagtgtcgtcgcaagagagaggggggagtctccttcaccacccagcggggatctcacggcttccttttctgtcctcctccaggatggggtcaaccgccatcctcgccctcctcctggctgttctccaaggagtctgtgccgaagtgcagctggtgcagcccggagcggtaatgaaaagcccggggagtctctgaggatctcctgtaagggttctggatacagctttagtaccttctggatcacctgggtgcgccagctgcccgggaaaggcctggaatggatggggaggattgaccccagtgactccagtaccaactacagtccgtccttcgaaggccacgtcagcatctcacttgacgtgtccaccaccactgtctacctacagtggcgcagcctcaagacatcggacaccgccacctattactgtgcacgacgccgttataccagaggctggtaccttgactcctggggccagggcaccctggtcaccgtctcctcacg

SEQ ID NO: 462296 - DNA, 508 bp, Homo sapiens; identical to SEQ ID NO: 446002
  misc_feature: HEFZJCU01DRPNX.9.78.H01.1.454.heavy.3.raw

SEQ ID NO: 462297 - DNA, 501 bp, Homo sapiens
  misc_feature: HEFZJCU01EWEAS.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccggtgaggggccgattcagcatctccagagacaacggcaagagtatactgtatctggaatgaacaatctgagagtcgacgatacggctgtctatcattgtgttttcgatgtccttcggtccgcgggacttcgtggggc

SEQ ID NO: 462298 - DNA, 521 bp, Homo sapiens
  misc_feature: HEFZJCU01BA83J.48.57.F02.1.454.heavy.3.raw
agtatacatacacgaccggtgctcgatttagctcgatatagttgggtttggcacgaccggtgctcgatttagctcgatatagttgggtttgggagggctttgttggagaccttgcacttggactcctgtgccccaccatggacacactttgctccacgctcctgctgctgaccatcccttcatgggtcttgtcccagatcaccttgaaggagtctgggccaacgctggtgaaacccacacagaccctcacgctgacctgcaccttctctgggttctcactcaccactgatgaggtgggtgtggcctggatccgtcagcccccgggaaaggccccggagtggcttggattgatttatggggatggtgacaagcgttacagtgcatctctgaagaccagactctccatcaccaaggacacctccaagaacgaggttgtcctttccttggccaacatgcaccctgtggacacggccactttatttttgtacacacaccatcttgacgtactggggatgcttttt

SEQ ID NO: 462299 - DNA, 503 bp, Homo sapiens
  misc_feature: HEFZJCU01CMK35.10.23.C01.1.454.heavy.3.raw
catagtagtgcacgaccggtgctcgatttagtacacgtgattagggattggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcagctttgatgaatatgccatggactgggtccggcaagttccagggaagggcctggagtgggtctcaggtattgattggaatagtggtaccattgcctatgcggactctgtgaagggccgattcaccatcaccagagacgacgccaggagctccctgtatctccaaatgaacagtctgagacctgaggacacggccttgtattactgtgtaagagggagtcagggtttctaac

SEQ ID NO: 462300 - DNA, 405 bp, Homo sapiens; identical to SEQ ID NO: 445302
  misc_feature: HEFZJCU01DFVPF.3.17.B06.1.454.heavy.3.raw

SEQ ID NO: 462301 - DNA, 530 bp, Homo sapiens
  misc_feature: HEFZJCU01A1TNN.8.34.D01.1.454.heavy.3.raw
ctcgcgtgtccacgaccggtgctcgatttagatcgtctgtgttgggtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaaggagggggaaccagcgggagttccaagtactcctttgacgtctggggccagggtaccctggtcaccgtctcctcagcctccaccaagggcccatcggtcttcccctggcgccctgctccaggagcacctccgagagcacg

SEQ ID NO: 462302 - DNA, 512 bp, Homo sapiens
  misc_feature: HEFZJCU01CU6ZQ.7.28.C06.1.454.heavy.3.raw
  modified_base (459)..(459): a, c, t, g, unknown or other
cgtgtctctacacgaccggtgctcgatttagagctcacgtattgggtttggggaggtctcagagaggagccttagccctggactccaaggccttccacagaggactcaccatggatttgggtctgagcgtggttttccgttgttaggctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtncgaaactctcattccgttcatctgaatctggggccagggaaccctggtcgccg

SEQ ID NO: 462303 - DNA, 496 bp, Homo sapiens; identical to SEQ ID NO: 458116
  misc_feature: HEFZJCU01ADUQ3.3.26.C04.1.454.heavy.3.raw

SEQ ID NO: 462304 - DNA, 525 bp, Homo sapiens
  misc_feature: HEFZJCU01AL3YJ.49.62.F07.1.454.heavy.3.raw
agtcgagagacacgaccggtgctcgatttagtagtcgcataaagggaaaggggggctgaactgggttttcctcgttgctcttttaagaggtgtccagtgtcaggtgcagctggtggagtctgggggaggcgtggtccagcctgggaggtccctgagactctcctgttcagcctctggattccccttcaatacctatcctttccactgggtccgccaggctcctggcaaggggctggagtgggtggcagttatatcatatgatggaagccataaaaactacgcagactccgtgacgggccgattcaccatctccagagacaattccagaaacacgctgcatctgcaaatgaacagcctgagacttgaggacacggctgtttattactgtgcgagagatgcgggatattgtggtggtgactgctatcttcccggtgcctactggggccagggaaccctggtcaccgtctcctcggcctccaccaggcccatcggtcttcccctggcaccctcctccagagcacctcg

SEQ ID NO: 462305 - DNA, 511 bp, Homo sapiens
  misc_feature: HEFZJCU01EWIII.52.53.E09.1.454.heavy.3.raw
cgcagtacgacacgaccggtgctcgatttagagagagtgtgttgggtttggggacccaacaaccacatccctcctcagaagccccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccggacaagggcttgtttggatgggatggatcaacgctggcaatggtaacacaaaatattcacagaagttccagggcagagtcaccatcaccagggacacatccgcgagcacagcctacatggagttgagcagcctgagaaatgaagacacggctgtatattactgtgcgagagggaaatggcctccaccaacggccatcggtcttcccctggcaccctcctccaacg

SEQ ID NO: 462306 - DNA, 485 bp, Homo sapiens
  misc_feature: HEFZJCU01EZK6X.8.39.D06.1.454.heavy.3.raw
ctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcacttcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggctac

SEQ ID NO: 462307 - DNA, 493 bp, Homo sapiens
  misc_feature: HEFZJCU01D3L6J.52.86.H09.1.454.heavy.3.raw
cgcagtacgacacgaccggtgctcgatttagtgctatagacttgggtttggggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcag

SEQ ID NO: 462308 - DNA, 506 bp, Homo sapiens
  misc_feature: HEFZJCU01B9HWV.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggtgaactactggggccagggcaccctggtcaccgtctcctcagcttccaccaagggcccatcggtcttcccctggcgccctgctccaggagcacctctggggcacagcggcctggctgcctggtccaggactactcccata

SEQ ID NO: 462309 - DNA, 528 bp, Homo sapiens
  misc_feature: HEFZJCU01EVWDY.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacgggtgtatacctatggtacgaaggaggggggaaccgagcgggagttccgaagtactcctttggacgtcgtc

SEQ ID NO: 462310 - DNA, 477 bp, Homo sapiens; identical to SEQ ID NO: 444659
  misc_feature: HEFZJCU01DZYNI.16.10.A10.1.454.heavy.3.raw

SEQ ID NO: 462311 - DNA, 477 bp, Homo sapiens; identical to SEQ ID NO: 444659
  misc_feature: HEFZJCU01CF97I.16.10.A10.1.454.heavy.3.raw

SEQ ID NO: 462312 - DNA, 395 bp, Homo sapiens; identical to SEQ ID NO: 444517
  misc_feature: HEFZJCU01BMK34.16.68.G02.1.454.heavy.3.raw

SEQ ID NO: 462313 - DNA, 502 bp, Homo sapiens
  misc_feature: HEFZJCU01ELM1B.4.57.F02.1.454.heavy.3.raw
agcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatagaacagtctgagagccgaggacacggctgtctatttattgtgcgagagtaagtggtcagtcgtcc

SEQ ID NO: 462314 - DNA, 482 bp, Homo sapiens
  misc_feature: HEFZJCU01EUUSM.47.85.H08.1.454.heavy.3.raw
agctcacgtacacgaccggtgctcgatttagtatcactcagtcggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctccgagagcacagcggcctggctgcctgtcaggactactcctacgtgagct

SEQ ID NO: 462315 - DNA, 486 bp, Homo sapiens
  misc_feature: HEFZJCU01BH3JX.47.85.H08.1.454.heavy.3.raw
agctcacgtacacgaccggtgctcgatttagtatcactcagtcggggaggcgtggtccagcctgggacgtccctgagactctcctgtgcagcctctggcgtcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgcctgctccaggagcacctccgagagcacagcggccctgggctgcctggtcaaggactacttcctacgtgagct

SEQ ID NO: 462316 - DNA, 529 bp, Homo sapiens
  misc_feature: HEFZJCU01DCP2O.12.39.D06.1.454.heavy.3.raw
  modified_base (494)..(494): a, c, t, g, unknown or other
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaatacgggaaaccgtttgactttggggccagggaacctggtcaccgtctcctcagcctccaccaagggcccatcggtcttcccctggccaccctcctccaanagcacctctgggggcacagcggcctgggctgcctc

SEQ ID NO: 462317 - DNA, 510 bp, Homo sapiens
  misc_feature: HEFZJCU01C90NG.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggtgaactactggggccagggcaccctggtcaccgtctcctcagcttccaccaagggccccatcggtcttcccctggcgccctgctccaggagcacctctgggggcacagcggccctgggctgcctggtcaaggactactcccata

SEQ ID NO: 462318 - DNA, 499 bp, Homo sapiens
  misc_feature: HEFZJCU01E0Y1W.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagaggagctattatctggaccccgat

SEQ ID NO: 462319 - DNA, 519 bp, Homo sapiens
  misc_feature: HEFZJCU01BO7FA.17.33.C11.1.454.heavy.3.raw
cgtagactagcacgaccggtgctcgatttagagtgagctcgttgggtttgggctcaactctcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctccaccaagggcccatcggtcttcccctggcaccctcctccaagagcacctctgggggcacagcggccctgggctgcct

SEQ ID NO: 462320 - DNA, 478 bp, Homo sapiens
  misc_feature: HEFZJCU01CMN61.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctctgggggcacagcggccctgggctgccctggtcaaggactacttccgagtagtaca

SEQ ID NO: 462321 - DNA, 531 bp, Homo sapiens
  misc_feature: HEFZJCU01ESTR1.52.53.E09.1.454.heavy.3.raw
cgcagtacgacacgaccggtgctcgatttagagagagtgtgttgggttttccttgttgctattttaaaaggtgtccagtgtggagtgcaggtggtggagtctgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttctgggccagggaacccgggtcaccgtctcctcagcctccaccaagggcccatcggtcttcccctggcaccctcctccaagagcacctctgggggcacagcggccctgggctgcctggtcaaggacta

SEQ ID NO: 462322 - DNA, 512 bp, Homo sapiens; identical to SEQ ID NO: 447732
  misc_feature: HEFZJCU01CGIJK.4.25.C03.1.454.heavy.3.raw

SEQ ID NO: 462323 - DNA, 533 bp, Homo sapiens
  misc_feature: HEFZJCU01BCK6Q.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcattttacttgaccccttgggggccggggaaccctggtcaccgtctccccaccctccaaccg

SEQ ID NO: 462324 - DNA, 519 bp, Homo sapiens
  misc_feature: HEFZJCU01B351T.10.44.D11.1.454.heavy.3.raw
catagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctctttttaagaggtgtccagtgtcaagtgcaactggtggagtctggggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaggaggggggaacagcgggagtccagtactccttgacgtctgggccgtac

SEQ ID NO: 462325 - DNA, 510 bp, Homo sapiens
  misc_feature: HEFZJCU01AEH4G.51.12.B01.1.454.heavy.3.raw
cgatcgtatacacgaccggtgctcgatttagtagtgtagattccgcgggggagagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcaggggtcatcatgaccggggacacgtccatcgccacaacttacatggaactgaccagtctgacatttgacgacacggccgtctattactgtgcgacagaagcggcggacagaggtcgcttactggttcgaggctctccccc

SEQ ID NO: 462326 - DNA, 491 bp, Homo sapiens; identical to SEQ ID NO: 452377
  misc_feature: HEFZJCU01CI6GB.4.28.C06.1.454.heavy.3.raw

SEQ ID NO: 462327 - DNA, 490 bp, Homo sapiens
  misc_feature: HEFZJCU01C2XLU.12.75.G09.1.454.heavy.3.raw
atacgacgtacacgaccggtgctcgatttagtatagacatcaggggccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattaccgcggacgaatccacgaccacagcctacatagagctgcgcagcctgagatctgaagacacggccatttattactgtgcgagagatgcagggccctcccacatcggttatttctttgactcctggggccagggaccctggtcaccgtctcctc

SEQ ID NO: 462328 - DNA, 525 bp, Homo sapiens; identical to SEQ ID NO: 452724
  misc_feature: HEFZJCU01A64YE.12.33.C11.1.454.heavy.3.raw

SEQ ID NO: 462329 - DNA, 494 bp, Homo sapiens
  misc_feature: HEFZJCU01A352W.48.23.C01.1.454.heavy.3.raw
agtatacatacacgaccggtgctcgatttagtacacgtgattagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagatacgtccaagaaccaattctccctgaagctgagctctgtgaccgccgcagacacggctgtctattactgtgcgaggccccgagcgcagtggcttttgatgccttgatatgtggggccagggacaat

SEQ ID NO: 462330 - DNA, 463 bp, Homo sapiens; identical to SEQ ID NO: 446208
  misc_feature: HEFZJCU01EZEDV.19.10.A10.1.454.heavy.3.raw

SEQ ID NO: 462331 - DNA, 427 bp, Homo sapiens; identical to SEQ ID NO: 444708
  misc_feature: HEFZJCU01DFU2A.9.34.D01.1.454.heavy.3.raw

SEQ ID NO: 462332 - DNA, 457 bp, Homo sapiens
  misc_feature: HEFZJCU01C3YLP.10.38.D05.1.454.heavy.3.raw
catagtagtgcacgaccggtgctcgatttagtatctgatagttgggtttgggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagccctccaccaagggcccatcggtcttccccctggcgccctgctccaggagcacctccgagagcacagcggccctgggctgcctggtcaaggactaccttccactactatg

SEQ ID NO: 462333 - DNA, 541 bp, Homo sapiens
  misc_feature: HEFZJCU01CWEXF.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggctttttcttgtggctttttaaaaggtgcccagtgtgaggtgcaactgttggagtctggggaggcttggtacagccggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattactgtgcgaaggatcgcccctataatggtgctggatcggggagtttggttccgtggggccaggggacccctgggtcc

SEQ ID NO: 462334 - DNA, 521 bp, Homo sapiens
  misc_feature: HEFZJCU01C2MFG.7.71.G05.1.454.heavy.3.raw
cgtgtctctacacgaccggtgctcgatttagtgtcgtcgcaagagagagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccgaggcggagttccaagtactcctttgacgtctc

SEQ ID NO: 462335 - DNA, 512 bp, Homo sapiens; identical to SEQ ID NO: 450914
  misc_feature: HEFZJCU01BUNKS.15.67.G01.1.454.heavy.3.raw

SEQ ID NO: 462336 - DNA, 528 bp, Homo sapiens
  misc_feature: HEFZJCU01EBG1A.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggatacagtggcagctccaagtactactttgacttctggggccagggaaccctggtcaccgtctcctcagcctccaccaagggcccatcggtcttcccctggcgccctcgctccaggagcacctccgagacg

SEQ ID NO: 462337 - DNA, 520 bp, Homo sapiens
  misc_feature: HEFZJCU01BOD2M.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggcgtgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccaagggaccg

SEQ ID NO: 462338 - DNA, 507 bp, Homo sapiens
  misc_feature: HEFZJCU01CG1TC.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagatacggccttatatttctgtgcgagagccctcggcagaagtctggactactactattatggtatggacgtctggggccaagggaccacggtcatcgtctcctcagcctccaccaagggcccatcggtcttcccctggccaccctcctccaagagcacctcgtgggggcacagcggccctgggctgcctggtcaaggactacttcctacgtcgtat

SEQ ID NO: 462339 - DNA, 488 bp, Homo sapiens
  misc_feature: HEFZJCU01D3WWT.12.53.E09.1.454.heavy.3.raw
atacgacgtacacgaccggtgctcgatttagagagagtgtgttgggtttggggggtccctgagactctcctgtgcagcctctcgattcagcttcagtaactatgctatgcactgggtccgccaggctccaggcagggggctggagtgggtggcagttatatcatatgatggaagacataaatactacgcagactccgtgaagggccgattcaccctctccagagacaattccaagaatacgctgtatatgcaaatgaacagcctgagacctgaggacacggctatgtattactgtgcgagaggaccattttggaatgcttattataccggaaacgcttttgatatttgggccaagggacaatggtcaccgtctcttcagcctccaccaagggcccatcggtcttcccctcggcaccctcctccaagagcacctctgggggcacagcggccctgggctgcctggtcaaggactacttcctacgtcgtat

SEQ ID NO: 462340 - DNA, 519 bp, Homo sapiens
  misc_feature: HEFZJCU01EFH83.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattacgtggggccggggaaccctggtcgccgtctcctcagcctccaccaagggcccatcggtcttccccctggcaccctcctccaagagcacctctgggggcacagcggccctggctgcctggtcaaggactacttccagacgtatca

SEQ ID NO: 462341 - DNA, 506 bp, Homo sapiens; identical to SEQ ID NO: 444696
  misc_feature: HEFZJCU01BTET2.16.34.D01.1.454.heavy.3.raw

SEQ ID NO: 462342 - DNA, 484 bp, Homo sapiens; identical to SEQ ID NO: 446564
  misc_feature: HEFZJCU01CMEXP.19.13.B02.1.454.heavy.3.raw

SEQ ID NO: 462343 - DNA, 501 bp, Homo sapiens
  misc_feature: HEFZJCU01AH17W.9.33.C11.1.454.heavy.3.raw
  modified_base (443)..(443): a, c, t, g, unknown or other
tgatacgtctcacgaccggtgctcgatttagagtgagctcgttgggtttggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggatacagtggcagctccaagtactactttgacttctggggccagggaaccctggtcaccgtctcctcagcctccaccaagggcccatcagtcttcccctggcgccctgctccaggancacctccgagagcacagcggccctgggctgcctggtcagactacttccagacgtatca

SEQ ID NO: 462344 - DNA, 507 bp, Homo sapiens
  misc_feature: HEFZJCU01EXZ8R.53.34.D01.1.454.heavy.3.raw
cgcgtatacacacgaccggtgctcgatttagatcgtctgtgttgggtttgggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttggtccagcctggggggtccctgagactctcctgtgcagcctctggattgaccgtcagtagcaactacatgagctgggtccgccaggccccagggaaggggctggagtgggtctcaacaatttatagcggtggtaggacataccacgcagaccccgtgaagggccgattcaccatctccagacacaattccaagaacacactgtttcttcaaatggacttcctgagaactgaggacacggccgtgtattactgcgcgagagtgcatgatagtggtttccatgatgcttttgat

SEQ ID NO: 462345 - DNA, 512 bp, Homo sapiens
  misc_feature: HEFZJCU01EM4VG.13.87.H10.1.454.heavy.3.raw
tcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttcctttttggctatttttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctat

SEQ ID NO: 462346 - DNA, 520 bp, Homo sapiens; identical to SEQ ID NO: 455235
  misc_feature: HEFZJCU01D3JDV.13.76.G10.1.454.heavy.3.raw

SEQ ID NO: 462347 - DNA, 463 bp, Homo sapiens
  misc_feature: HEFZJCU01CZRFI.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacgggggaaaattgggccagggaaccctggtctccgtctcgtcagcctccaccaagggcccatcggtcttccccctggcgccctgctccaggagcacctccgagagcacagcggccctgggctgcctggtcaaggactacttcccacgagagta

SEQ ID NO: 462348 - DNA, 535 bp, Homo sapiens
  misc_feature: HEFZJCU01CD22O.52.33.C11.1.454.heavy.3.raw
cgcagtacgacacgaccggtgctcgatttagagtgagctcgttgggtttggggggctctgggagaggagcccagcactgggattccgaggtgtttccattcagtgatctgcactgaacacagaggactcgccatggagtttgggctgagctgggttttccttgttgctattttaaaaggtgtccagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagcccgtaacttctggggccagggaacccgggtcaccgtctcctcagcctccaccaagggcccatccggtcttccccctcggccaccctcctccaagacgcacctcgtc

SEQ ID NO: 462349 - DNA, 500 bp, Homo sapiens; identical to SEQ ID NO: 444529
  misc_feature: HEFZJCU01ESMVZ.12.38.D05.1.454.heavy.3.raw

SEQ ID NO: 462350 - DNA, 515 bp, Homo sapiens
  misc_feature: HEFZJCU01BZ1R0.10.53.E09.1.454.heavy.3.raw
catagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgttctgcaaatgaacagcctgagagctgaggacacggctgtgtattactgttcgtttggttctgactcgtcgggggaataccgttcagcactgggccga

SEQ ID NO: 462351 - DNA, 511 bp, Homo sapiens
  misc_feature: HEFZJCU01CTT0G.48.10.A10.1.454.heavy.3.raw
agtatacatacacgaccggtgctcgatttagcgtcgatctcaggggagctctgggagaggagctccagccttgggattcccagctgtctccactcggtgatcggcactgaatacaggagactcaccatggagtttgggctgaactgggttttccttgttgctattttaaaaggtgtccagtgtgaggtgcagctggtggagtccgggggagccttggttcagcctggggggtctctgaactctcctgtgcagcctctgggttcatgttcaatgtctctgctattcactgggtccgccaggcttccgggaaagggctggaatgggttggtcgtattagaactaaagtaaatagttacgcgacagcagatgctgcgtcggtgaaaggcaggttcaccatctccagagatgattcaaagaacacggcgtatctgcaaatgaacagcctgaaaaccgaggacacggccattttatttttgtgctagatctgaagaattaccagctgctgtgttct

SEQ ID NO: 462352 - DNA, 524 bp, Homo sapiens
  misc_feature: HEFZJCU01AMULZ.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatccggtcttccccctggccg

SEQ ID NO: 462353 - DNA, 513 bp, Homo sapiens; identical to SEQ ID NO: 446699
  misc_feature: HEFZJCU01B94LF.12.25.C03.1.454.heavy.3.raw

SEQ ID NO: 462354 - DNA, 521 bp, Homo sapiens
  misc_feature: HEFZJCU01C3TCB.49.35.D02.1.454.heavy.3.raw
agtcgagagacacgaccggtgctcgatttagcacacgatagttgggtttgggggggagaggagcccagcactagaagtcggcggtgtttccattcggtgatcagcactgaacacagaggactcaccatggagtttgggctgagctgggttttcctcgttgctcttttaagaggtgtcctttgtcgggtgcagttggtggagtcggggggatctgtggtccggcctgggaagtccctgagactctcctgtactgcctccggattcaagttcgaaaattatggcttacactgggtccgccaggctccaggcaaggggctggagtgggtggcagtaatttcatatgattcaagtattggatattacgcagagtccgtaaagggccgattcaccatctccagagacaattcgaagaacaccatgtatctggaactgagcagagtcacatctgaggacacggctatgtattactgtgtgaaagacttttatgacagtagtggtttctccgagtatgcacattacgg

SEQ ID NO: 462355 - DNA, 494 bp, Homo sapiens
  misc_feature: HEFZJCU01BOB7T.52.72.G06.1.454.heavy.3.raw
cgcagtacgacacgaccggtgctcgatttagctacgactgcaagggaaagggggggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctgggggggcgtggtccagcctgggaggtccctgagactctcctgtgcaggctctgcatttcccttcagtaactatgctatcgattgggtccgccaggctccaggcaagggactggagtgggtggcagttatatcagctgatggaggcagtaaatattacgcagattctgcgagggccgattcaccatatccagagacaactcccaagatatgatatatctacaaatgaacagcctgagacctgaggacacggctgtatattattgtgcgtcaggggcagtgcctggccacg

SEQ ID NO: 462356 - DNA, 531 bp, Homo sapiens; identical to SEQ ID NO: 446857
  misc_feature: HEFZJCU01BFAE3.7.78.H01.1.454.heavy.3.raw

SEQ ID NO: 462357 - DNA, 521 bp, Homo sapiens
  misc_feature: HEFZJCU01EMYMG.2.81.H04.1.454.heavy.3.raw
acgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctggtggagtccgggggaggctgggtccagcctggggggtccctgagactctcctgttcagcctctggattcacctttagtaggttttggatgagttgggtccgccaggctccagggaaggggctggagtgggtggccaacatagagtacgatggaagtgagaaaaactatgtggactccgtgaagggccgattcaccatctccagagacaacgacaagaatttagtgtatctgcaaatgagcagcctgagagccgaggacacggctgtgtattattgtgcgag

SEQ ID NO: 462358 - DNA, 489 bp, Homo sapiens
  misc_feature: HEFZJCU01EOFQL.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctccgagagcacagcggcccgtggctgcctggtcaaggactacttcctacgtgagct

SEQ ID NO: 462359 - DNA, 530 bp, Homo sapiens
  misc_feature: HEFZJCU01ASLK7.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggccctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggacgtacggtgactactgggggttcgacccctgggggccaggggaaccctggtcaccgtctcctcagcctccaccg

SEQ ID NO: 462360 - DNA, 511 bp, Homo sapiens
  misc_feature: HEFZJCU01EPO1G.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggcaccctcctccaagagcacctctgggggcacagcggccctgggctgcctggtcaaggactactccgagtgcgtct

SEQ ID NO: 462361 - DNA, 526 bp, Homo sapiens
  misc_feature: HEFZJCU01D2Z3K.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcgaggggcacctggtggagtcgtgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaacgggcccatcggtccttcccctggccg

SEQ ID NO: 462362 - DNA, 528 bp, Homo sapiens
  misc_feature: HEFZJCU01CVLE4.13.39.D06.1.454.heavy.3.raw
tcacgtactacacgaccggtgctcgatttagtgacatctcgcagttctttggggagctctgggagtggagccccagccttgggattcccaagtgtttgttttccgtgatcaggactgaacacacaggactcaccatggagttggggctgagctggattttccttcttgctatgttagaaggtgtccagtgtgaggtgcacctggtggagtctgggggaggcttggtacagcctggggggtccctgagactctcctgtgcagcctctggattcaccttcagtacctacgacatgcactgggtccgccaacctctaggaaaaggtccggagtgggtctcagggattggcagtgttggtgacacattctattcagactccgtgaagggccgattcaccatctccagagaaaatgccaacaactccttccatcttcaaatgaacagcctgagagacgggggacacggctgtgtattactgtgcaagagggcgaatttcttattactacttcgacgtctggggcaagggaccg

SEQ ID NO: 462363 - DNA, 521 bp, Homo sapiens
  misc_feature: HEFZJCU01A9THK.49.37.D04.1.454.heavy.3.raw
agtcgagagacacgaccggtgctcgatttagtagcatactgttgggtttgggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctatatggaactgagcggcctgagatttgaagacacggctgtgtattactgtgcgagagcaacggtcgtcatgggatttgactactggggccagggaacccggtcaccgtctcctctgcctccaccaaggcccatcggtcttcccctggcaccctcctccaagagcacctcctgggggccacagcggccctggg

SEQ ID NO: 462364 - DNA, 397 bp, Homo sapiens; identical to SEQ ID NO: 446011
  misc_feature: HEFZJCU01BQWZN.21.60.F05.1.454.heavy.3.raw

SEQ ID NO: 462365 - DNA, 531 bp, Homo sapiens
  misc_feature: HEFZJCU01DBH58.18.33.C11.1.454.heavy.3.raw
  modified_base (465)..(465): a, c, t, g, unknown or other
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgngtggggcatttacttgacccctggggaccggggaaccctggtccacgtcctccccaccctccaccg

SEQ ID NO: 462366 - DNA, 535 bp, Homo sapiens
  misc_feature: HEFZJCU01CYOL2.17.28.C06.1.454.heavy.3.raw
  modified_base (504)..(504): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcaggcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtatggctgngtttatggggtccagggagccctggtcaccg

SEQ ID NO: 462367 - DNA, 506 bp, Homo sapiens; identical to SEQ ID NO: 449588
  misc_feature: HEFZJCU01ASGTE.11.72.G06.1.454.heavy.3.raw

SEQ ID NO: 462368 - DNA, 503 bp, Homo sapiens
  misc_feature: HEFZJCU01C3CFP.10.23.C01.1.454.heavy.3.raw
catagtagtgcacgaccggtgctcgatttagtacacgtgattagggattgggaggcttggtacagcctggcaggtccctgagactctcctgtgcagcctctggattcagctttgatgaatatgccatggactgggtccggcaagttccagggaagggcctggagtgggtctcaggtattgattggaatagtggtaccattgcctatgcggactctgtgaagggccgattcaccatcaccagagacgacgccaggagctccctgtatctccaaatgaacagtctgagacctgaggacacggccttgtattactgtgtaagagggagtcagggtttcaactattatagtagtggttatgactactggggccagggaaccctggtcaccgtctcctcagcctccaccaagggccatcggtcttcccctgcgccctgctccaggagcacctccgagagcacagcggccctgggctgcctggtcaaggactacttcccactacctatg

SEQ ID NO: 462369 - DNA, 509 bp, Homo sapiens; identical to SEQ ID NO: 452959
  misc_feature: HEFZJCU01CIHT3.2.33.C11.1.454.heavy.3.raw

SEQ ID NO: 462370 - DNA, 525 bp, Homo sapiens
  misc_feature: HEFZJCU01DM6NL.13.33.C11.1.454.heavy.3.raw
tcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacggcaaatatggttcagggagttcgactacgtggggccagggaaccctggtcaccgtctcctcacgcctccaccgaacggg

SEQ ID NO: 462371 - DNA, 519 bp, Homo sapiens
  misc_feature: HEFZJCU01CM73P.49.19.B08.1.454.heavy.3.raw
agtcgagagacacgaccggtgctcgatttagtgagtcagtaagggggctctgagagaggagcccagccctgggattttcaggtgttttcatgtggtgatcaggactgaacagagagaactcaccatggagtctgggctgacgtggcttttgcttgtggctatcttaaaaggtgtccagtgtgacgtgcagttggtggagtcggggggaggcttggtacagccgggggggtccctgagactctcctgtacagtctctggcttcacctttagagtctatgacatgagttgggtccgccaggctccggggaaggggctggagtgggtctcaacgatcagtgatagtggaactaagacaaactatgccgactccgtgaagggccgatgcaccatctccagagacaactcgaaggacactttatatctgcaactcaacagactgacaaccgcggacgcggccgtctattactgtgtgaaagagacggaccgctggacgaggagccagaggaaaatcaactactt

SEQ ID NO: 462372 - DNA, 532 bp, Homo sapiens
  misc_feature: HEFZJCU01EMJGE.52.45.E01.1.454.heavy.3.raw
cgcagtacgacacgaccggtgctcgatttagtgagtcagtaagggaaaggggggcgtctgggagaggagcccagcactgggattccggggtgtttccattcagtgatctgcactgaacacagaggactcgccatggagtttgggctgagctgggttttccttgttgctattttaaaaggtgtccattgtgaggtgcagctggtggagtctgggggaggcttggtccagccgggggggtccctgagactctcctgtgcagcctctgaattcagcgtcagtagcgactacatgagctgggtccgccaggctccagggaaggggctgggagtgggtcacagttattccaaccggtgggagcgcacactacgcagattccgtgaagggcaggttcaccgatctccagagacaatttgaggaacacggtgcatcttcacatgaacagcctgaggagccgaggacgatggctgtttattactgtgcgagggtaaattggaactacgcggggacttcgaccctggggccagggaacccg

SEQ ID NO: 462373 - DNA, 491 bp, Homo sapiens; identical to SEQ ID NO: 447066
  misc_feature: HEFZJCU01CRIJX.11.13.B02.1.454.heavy.3.raw

SEQ ID NO: 462374 - DNA, 510 bp, Homo sapiens
  misc_feature: HEFZJCU01EGFSH.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcaccctcctccaagagcacctctgggggcacagcggccctgggctgccgtggtcaaggactacttcctacgtcgtat

SEQ ID NO: 462375 - DNA, 506 bp, Homo sapiens
  misc_feature: HEFZJCU01BC3CP.47.81.H04.1.454.heavy.3.raw
agctcacgtacacgaccggtgctcgatttagtagtgtagattcgcggggagctctgggagtggagccccagccttgggattcccaagagtttgtattcagtgatcaggactgaacacacaggactcaccatggagttggggctgagcgtgggttttccttgttgctatattagaaggtgtccagtgtgaggtgcagctggtggagtcggggggaggcctggtacagcctggggggtccctgagactctcctgtgcagcctctggattcatcttcagtgactacgacatgcactgggtccgccaagttgcaggagaacctctggaatgggtctccgttattgctactggtggtgccacagactatgcaggctccgtgaggggccgattcaccatctccagagaaaatggcaagaactccttgtatcttcaaatgaacagcctgagagccggggacacggcggtgtattactgtgtaagagagctcgatggtaacgaggggacttaat

SEQ ID NO: 462376 - DNA, 530 bp, Homo sapiens; identical to SEQ ID NO: 454983
  misc_feature: HEFZJCU01BBZIJ.7.78.H01.1.454.heavy.3.raw

SEQ ID NO: 462377 - DNA, 502 bp, Homo sapiens
  misc_feature: HEFZJCU01B6VTV.17.74.G08.1.454.heavy.3.raw
cgtagactagcacgaccggtgctcgatttagtagctctatcagggtcttcgtggctcacgtccaccaccacgcatgtgacctcaggggtccctgagactctcctgtgcagcctctggattcaccttcagtacctactggatgcactgggtccgccaagctccagggaaggggctggagtggctctcacgtgttgataatgttggcagtttcacaaaatacgcggactccgtgaagggccgattcaccatctccagagacaacgccaagaacacgctgtatctgcaaatgaacagtctgagagccgaggacacggctgtttattactgtgcaagacagcactacagtcactacttcgacccctggggccagggaaccctggtcaccgtctcctcagcctccaccaagggcccatcggtcttccccctggcaccctcctccaagagcacctctgggggcacagcggccctgggctgcctggtcaggactacttcctagtctacg

SEQ ID NO: 462378 - DNA, 395 bp, Homo sapiens
  misc_feature: HEFZJCU01DNBPN.48.44.D11.1.454.heavy.3.raw
agtatacatacacgaccggtgctcgatttagcgcagtacgaaggggcgattcaccttctccagaggcaattccaagaacaccctgtgtcttcgtgggtctcatttctttatagcggtgttaggacaacctacgcagactccgtgaaggggcgattcaccttctccagaggcaattccaagaacaccctgtatcttcaaataaacagtctaagagccgaggacacggccctgtgttacggccggtgacggaaccggtggctagcggggccagggaaccctggctcagcctccaccaagggcccatcggtcttccccctggcaccctcctccaagagcacctctgggggcacagcggccctgggctgcctggtcaaggactacttcctatgtatact

SEQ ID NO: 462379 - DNA, 502 bp, Homo sapiens
  misc_feature: HEFZJCU01DNJ42.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaacgtcctatgcttttgatatctggggccaaggggac

SEQ ID NO: 462380 - DNA, 506 bp, Homo sapiens; identical to SEQ ID NO: 444696
  misc_feature: HEFZJCU01C1WK2.16.34.D01.1.454.heavy.3.raw

SEQ ID NO: 462381 - DNA, 525 bp, Homo sapiens
  misc_feature: HEFZJCU01CNPLS.13.38.D05.1.454.heavy.3.raw
tcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtctggggggggcttggttaagcctggggggtccctcagactctcctgtgcaacctctggattcattttctctgacgcctggttgagctgggtccgccaggctccgggaaggggctggagtgggttggccgtattaaaggtagaagacatggtcggacaacagactacagtgttcccgtgaaaggcagattcactatctcaagagatgactcaaaagaaatgatatatctgcaaatgaacaacctgaaaagcgaggacacaggcgtgtattactgtaccacagatgggccagatgcaaatggcgcgacgagttcgactactc

SEQ ID NO: 462382 - DNA, 534 bp, Homo sapiens
  misc_feature: HEFZJCU01DTP47.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggacgtacggtgactacgtgggggttccgaccccgtgggggccacgggaaccctggtcaccgtctcctcacgcctccaaccg

SEQ ID NO: 462383 - DNA, 510 bp, Homo sapiens
  misc_feature: HEFZJCU01C8OP6.4.30.C08.1.454.heavy.3.raw
agcactgtagcacgaccggtgctcgatttagtctgacgtcaaagggaaaggggctcagagaggagccttagccctggactccaaggcctttccacttggtgatcagcactgagcacagaggactcaccatggaattggggctgagctgggttttccttgttgctattttagaaggtgtccagtgcgaggtgcagctggtggagtctgggggaggcttggtccagcctggggggtccctgagactctcctgtgcagcctctggattcacctttactacctattggatggactgggtccgccaggctccagggaaggggctggagtgggtggccaacataaaccaagatggaagtgaacagtactatgtggactctgtgaagggccgattcaccatctccagagacaacgccaagaactcactgtatctgcaaatgaacagcctgagagccgaggacacggctatttattactgtgtgaaagagaactggttcttcgatctctggggcctgg

SEQ ID NO: 462384 - DNA, 523 bp, Homo sapiens
  misc_feature: HEFZJCU01CHKJE.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggcctccgagggaaggggctggagtgcgtctcttttatttatagtagtggtagtacatactccgcagactccgtgaggggccgattccaccatctccagagacaattccaagaacacgctgtttcttcaaatgaacagcctgagagccgatgacacggccgtgtattactgtgcgagagatggggcccacgaacgttactacgctatggacgtctggggccaagggacccg

SEQ ID NO: 462385 - DNA, 514 bp, Homo sapiens
  misc_feature: HEFZJCU01CFU6J.40.37.D04.1.454.heavy.3.raw
  modified_base (154)..(154): a, c, t, g, unknown or other
tctagcgactcacgaccggtgctcgatttagtagcatactgttgggtttggggagctctgagagaggagcccagccctgggattttcaggtgttttcatttggtgatcaggactgaacagagagaactcaccatggagtttgggctgagcgtgngtttctaggtggctattttaaaaggtgtccagtgtgaggtgcagttgttggaatctgggggaggcttggtacagcctggggggtccctgagactctcctgtgcagcctctggattcacctttagcaactatgccatgacctgggtccgccagactccagggacggggctggagtgggtttcatctattggtggtggttggcattgacacaccactacgccgactccgtgaagggccggttcaccatctccagagacaattccaggaacacactgtatctgcaaatgaacggcctgacagccgaggacacggccaaaatattactggtgtgaaggatcaggaagtgggagctggtagcctc

SEQ ID NO: 462386 - DNA, 397 bp, Homo sapiens
  misc_feature: HEFZJCU01C37EV.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctcccgagagcacagcggccctgggctgcctggtcaaggactacttcctacgtgagct

SEQ ID NO: 462387 - DNA, 507 bp, Homo sapiens; identical to SEQ ID NO: 454278
  misc_feature: HEFZJCU01A4SSW.17.25.C03.1.454.heavy.3.raw

SEQ ID NO: 462388 - DNA, 513 bp, Homo sapiens; identical to SEQ ID NO: 446699
  misc_feature: HEFZJCU01BI2I5.12.25.C03.1.454.heavy.3.raw

SEQ ID NO: 462389 - DNA, 511 bp, Homo sapiens
  misc_feature: HEFZJCU01BEEWN.4.25.C03.1.454.heavy.3.raw
agcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgtttctgcaaatgaacagcctgagagccgaggacacggctgtgtatcactgtgtcagagatgccgagggcggttaccctctggttccttcgacagttatggtatggacgtcgtggggcctagggactacggtcaccgtctcctcagcctccaccaacgggcccagtcggtccttcccc

SEQ ID NO: 462390 - DNA, 530 bp, Homo sapiens
  misc_feature: HEFZJCU01A68YS.9.30.C08.1.454.heavy.3.raw
tgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgactccatcaccggtactaattactactggagttggatccgccagccccccgggaagggcctggagtggattggatacgccttttacagtggagtcacctactacaacccgtccctcaagagccgagttaccatatctgtcgacacgtcccagaatcagttctccctggaggtgacctctgtgactgccgcagacctcggccgtgtatttctgtgccagaacgcaaagcagcgcctactatactttaaactttgacttcgtgggccagggatccctggtcaccgtctcctcacgcctaccc

SEQ ID NO: 462391 - DNA, 521 bp, Homo sapiens
  misc_feature: HEFZJCU01DJYAX.4.33.C11.1.454.heavy.3.raw
agcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctgggagtgggtaggtttcattagagccatggcttatgctgggacaacagaatacgccgcgtctgtgaaaggcagattcatcatctcaagagatgattccaacggcatcgcctatctgcagatgaacagcctgaagaccgaggacacagccgtctattactgttgttaggtagttttacgtagtttttggaggtggatagtttaa

SEQ ID NO: 462392 - DNA, 493 bp, Homo sapiens
  misc_feature: HEFZJCU01B3R4C.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttccccctggccgccctgcctccaggagcacctccgagagcacagcggccctgggctgcctggtcaggactacttccgtatctctcg

SEQ ID NO: 462393 - DNA, 395 bp, Homo sapiens; identical to SEQ ID NO: 444517
  misc_feature: HEFZJCU01BUUKH.16.68.G02.1.454.heavy.3.raw

SEQ ID NO: 462394 - DNA, 520 bp, Homo sapiens
  misc_feature: HEFZJCU01AHJDO.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataaccgttcgcctggttatttacc

SEQ ID NO: 462395 - DNA, 470 bp, Homo sapiens; identical to SEQ ID NO: 444866
  misc_feature: HEFZJCU01CME3N.4.36.D03.1.454.heavy.3.raw

SEQ ID NO: 462396 - DNA, 503 bp, Homo sapiens
  misc_feature: HEFZJCU01B50OJ.10.28.C06.1.454.heavy.3.raw
catagtagtgcacgaccggtgctcgatttagagctcacgtattgggtttgggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtggagtcggggggaggcttggtacagcctggggggtccctgagactctcctgtgtagcgtctggattcacattcagtagttatagcatgaactgggtccgccaggctccagggaagggctggagtgggtttcatatattgatagaaatagtggaaccatatactatgcagactctgtgaggggccgattcaccatctccagagacaatgccaggaattcactgtatgtggaaatgaacagtctgagagccgaggacacggctctctattactgtgcgagagcccgaaaataggtactacg

SEQ ID NO: 462397 - DNA, 508 bp, Homo sapiens
  misc_feature: HEFZJCU01C9P8T.48.57.F02.1.454.heavy.3.raw
agtatacatacacgaccggtgctcgatttagctcgatatagttgggtttggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagaagggttttactatggttcggggatctccgacccagcaactggttaccg

SEQ ID NO: 462398 - DNA, 512 bp, Homo sapiens; identical to SEQ ID NO: 445688
  misc_feature: HEFZJCU01ER5KU.3.34.D01.1.454.heavy.3.raw

SEQ ID NO: 462399 - DNA, 525 bp, Homo sapiens
  misc_feature: HEFZJCU01CNXPL.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacgaacgttacctacgctatggacgtcgtggggccgaaggggacccg

SEQ ID NO: 462400 - DNA, 499 bp, Homo sapiens
  misc_feature: HEFZJCU01DJ7ZK.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctgggtcaccgtctcctcagcctccaccaagggcccatcggtcttcccctggcgccctgctccaggagcacctccgagagcacagcgccctgggctgcctggtcaggactacttcctacgtcgtat

SEQ ID NO: 462401 - DNA, 516 bp, Homo sapiens
  misc_feature: HEFZJCU01EV4T5.51.26.C04.1.454.heavy.3.raw
cgatcgtatacacgaccggtgctcgatttagtctagcgactttgggtttggggagctctgggagacgagcccagcactggaagtcgccggtgtttccattcggtgatcatcactgaacacagacatggagtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgctaaac

SEQ ID NO: 462402 - DNA, 515 bp, Homo sapiens
  misc_feature: HEFZJCU01CAZX6.49.23.C01.1.454.heavy.3.raw
agtcgagagacacgaccggtgctcgatttagtacacgtgattagggattgggggcatcacataacaaccagattcctcctctaaagaagcccctgggagcacagctcatcaccatggactggacctggaggttcctctttgtggtggcagcagctacaggtgtccagtcccaggtccagctggtgcaatctggggctgaggtgaagaagcctgggtcctcggtgaaggtctcctgtaaggcttctggaggcaccctcagcagttatactatgaattgggtgcgacaggcccctggacaagggcttgagtggatggggaggatcatccctattgttggtgtgacaaactacgcacagaagttccaggacagaatcacgataaccgcggacacatccacgagcactattttcatggaactgagcagcctcagatccgaggacacggccgtttactactgtgcgagcgatcccggattcccgcgtttcgaggatgactactggggccagggtaacccg

SEQ ID NO: 462403 - DNA, 495 bp, Homo sapiens
  misc_feature: HEFZJCU01DC1LR.10.21.B10.1.454.heavy.3.raw
catagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcgtggtttccgtcgttaggctctttaagagatgtccagtgtcagatgcagatggtggagtctgggggaggcgtggtccggcctggggggtccctgagactctcctgttctgcgtctggattcatctttagtaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttatactgtgggagaaatcctagtggcta

SEQ ID NO: 462404 - DNA, 385 bp, Homo sapiens
  misc_feature: HEFZJCU01C2020.18.60.F05.1.454.heavy.3.raw
tacgagtatgcacgaccggtgctcgatttagtacgtcatcagggaaaggggctggaatatattgggattacctcttacagtgggaccacccattacaacccgtccctcaaaagtcgactcaccatttccgtggacacgtcgaaaacgagttctccctggacttgacctctgtgaccgccgcagacacggctgtttattactgtgcgagacgactacctgactccaatccatactttgactattggggccgggagccctggtcaccgtctcctcagcctccaccaagggcccatcggtcttccccctggcgccctgctccaggagcacctccgagagcacagcggccctgggcctgcctggtcaaggactacttcccatactcgta

SEQ ID NO: 462405 - DNA, 480 bp, Homo sapiens; identical to SEQ ID NO: 446171
  misc_feature: HEFZJCU01DQ0TF.22.36.D03.1.454.heavy.3.raw

SEQ ID NO: 462406 - DNA, 526 bp, Homo sapiens; identical to SEQ ID NO: 447476
  misc_feature: HEFZJCU01ALAR4.14.55.E11.1.454.heavy.3.raw

SEQ ID NO: 462407 - DNA, 505 bp, Homo sapiens
  misc_feature: HEFZJCU01ESPDD.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagacgtcccacgatccgggtgagcctacggcagcggcctttgacttctc

SEQ ID NO: 462408 - DNA, 501 bp, Homo sapiens
  misc_feature: HEFZJCU01E0SER.17.10.A10.1.454.heavy.3.raw
cgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaatttgataggctctatggactggacttcgtc

SEQ ID NO: 462409 - DNA, 502 bp, Homo sapiens
  misc_feature: HEFZJCU01AZA58.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccaggggaagcctggtccaccgtctcctcagcctccaccaagggcccatcggtcttcccctggcgccctgctccaggagcacctccgagagcacagcggccctgggctgcctggtcaaggactacttcctacgtcgtat

SEQ ID NO: 462410 - DNA, 502 bp, Homo sapiens
  misc_feature: HEFZJCU01CSF9X.49.31.C09.1.454.heavy.3.raw
agtcgagagacacgaccggtgctcgatttagacgtctcatcaaggaaggaagggacctcaggggtccgggagatcatgagggtgtccctgggactctcctgtgcagcctctggattcactttcagcagctatggcatgaactgggtccgccaggctccagaaaaggggctggagtgggtctcaggtattagtggtagtggtggtatcacatcctacgtagactccgtgaagggccggttcaccatctccagagacaattccaagaacaaactttatttgcacatggaaagcctgagagccgaggacacggccatatattactgtgcgagacgtgggaactacttaggaggtgcttttgatgtctggggccaagggacaatggtcaccgtctcttcagcctccaccaaggcccatcggtcttccccctggcaccctcctccaagagcacctctgggggcacagcggccctgggctgctggtcaaggactactctctctcgact

SEQ ID NO: 462411 - DNA, 515 bp, Homo sapiens
  misc_feature: HEFZJCU01B558V.26.71.G05.1.454.heavy.3.raw
agactatactcacgaccggtgctcgatttagtgtcgtcgcaagagagaggggggggaagaggaagactgacggtcctgcgctggtggagcccacgcagaccctcacgctgacctgctccgtctctggattctcactcaccacgactgaggtgaatgtggcctgggtccgtcaggcccccggaaaggccctggagtggcttgcactcatttactggagtgatctcaagcggtacaatccgtctctgaggaatcgactcaccatcaccagggacacctccaaagaccgggtggtccttacaatgaccgacatgaatcctgtggacacaggcacatattactgtgcacacagtcctagcggctacgcgagaaaagaatatgactattggggccagggaattttggtcaccgtctccccagcctccaccaagggcccatcggtcttcccctggcgccctgctccaggagcacctccgagagcacagcggccctgggctgcctggtcaaggactacttcc

SEQ ID NO: 462412 - DNA, 543 bp, Homo sapiens
  misc_feature: HEFZJCU01CEYXV.18.59.F04.1.454.heavy.3.raw
tacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaaatgaacagcctgagaaccgaaggacacagccgtgtagttactgtaccacatcccctgaaagcgtcaactactactactacggtatggacctctggggccaagggaccg

SEQ ID NO: 462413 - DNA, 489 bp, Homo sapiens; identical to SEQ ID NO: 444791
  misc_feature: HEFZJCU01AYKEU.47.85.H08.1.454.heavy.3.raw

SEQ ID NO: 462414 - DNA, 505 bp, Homo sapiens; identical to SEQ ID NO: 445638
  misc_feature: HEFZJCU01BVZMR.11.40.D07.1.454.heavy.3.raw

SEQ ID NO: 462415 - DNA, 506 bp, Homo sapiens; identical to SEQ ID NO: 444696
  misc_feature: HEFZJCU01CW98G.16.34.D01.1.454.heavy.3.raw

SEQ ID NO: 462416 - DNA, 490 bp, Homo sapiens
  misc_feature: HEFZJCU01D05ZR.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagt

SEQ ID NO: 462417 - DNA, 533 bp, Homo sapiens
  misc_feature: HEFZJCU01B22RI.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagcgtggattttccttagctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacatccctgaaagcgtcaactactactactcgtatggacctctgggccg

SEQ ID NO: 462418 - DNA, 496 bp, Homo sapiens
  misc_feature: HEFZJCU01B4VCK.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtcctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagatttctatagaggtgactacgggggcgttc

SEQ ID NO: 462419 - DNA, 518 bp, Homo sapiens
  misc_feature: HEFZJCU01BG1MK.52.52.E08.1.454.heavy.3.raw
cgcagtacgacacgaccggtgctcgatttagtcgagctctcagagagaaaggggatactttctgagactcatggacctcctgcacaagaacatgagacacctgtggttcttcctcctcctggtggcagctcccagatgggtcctgtctcaggtgcagctgcaggagtcgggcccaggactggtgaagccttcggggaccctgtctctcacctgcgctgtctctggtgggtccatcagaagtagtaactggtggagttgggtccgccagcccccagggaagggtctggagtggattggggaaatctatcatactgggaacaccaactacagcccgtccctcaagagtcgagtcgccatatcactagaccaggcgaacaacgagttctccctgaaactgagctctgtgaccgccgcagacacggccgtgtattattgtgggagagatcggagagatagtagtggtttttactacggtgactacgacggtatggacgtcgtggggccaagggaccacggtc

SEQ ID NO: 462420 - DNA, 498 bp, Homo sapiens
  misc_feature: HEFZJCU01C7X4K.9.14.B03.1.454.heavy.3.raw
tgatacgtctcacgaccggtgctcgatttagtgtgagtagtttgggtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagagatgtgtacgcttttgatatctggggccaagggacaatggtcaccgtctcttcagcctccaccaagggcccatcggtcttcccctggcgccctgctccaggagcacctccgagagcacagcggccctgggctgcctggtcgaaggactatttccagacgtatca

SEQ ID NO: 462421 - DNA, 508 bp, Homo sapiens
  misc_feature: HEFZJCU01BK643.53.53.E09.1.454.heavy.3.raw
cgcgtatacacacgaccggtgctcgatttagagagagtgtgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgacccctggggccagggaaccctggtcaccgtctcctcagcttccaccaagggcccatcggtcttcccctggcgcccg

SEQ ID NO: 462422 - DNA, 481 bp, Homo sapiens
  misc_feature: HEFZJCU01DBVJ3.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaccgaagacacgggcgtgtatttttgtgccagagaagagggatattgctctgatggtgtctgctattacgtctacggtttggacgtctggggccaagggaccacggtcatcgtctcctcagcctccaccagggcccatcggtcttcccctggcaccctcctccaagagcacctctgggggcacagcggccctgggctgcctggtcaaggactacttccgtatctctcg

SEQ ID NO: 462423 - DNA, 480 bp, Homo sapiens
  misc_feature: HEFZJCU01D85T1.49.67.G01.1.454.heavy.3.raw
agtcgagagacacgaccggtgctcgatttagagtatacatattgggtttggggtgggagaggagcccagcactagaagtcggcggtgcttccattcggtgatcagcactgaacacagaggactcaccatggagtttgggctgagcgtggttttccgtcgttaggctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtggggtggcagttatatcatatgatggaagcaagatatactatgtagactccgtgaagggccgattcatcatctccagagacaactccgagaacacgctgtatctgcaaatgaacaggctgagagctgaagacacggctgtatattactgtgcga

SEQ ID NO: 462424 - DNA, 508 bp, Homo sapiens
  misc_feature: HEFZJCU01D3DJH.48.2.A02.1.454.heavy.3.raw
agtatacatacacgaccggtgctcgatttagactcatctacaggggtcagagaggagccttagccctggactccaaggcctttccacttggtgatcagcactgagcacagaggactcaccatggaattggggctgagctgggttttccttgttgctattttagaaggtgtccagtgtgaggagcagctggtggagtctgggggaggcttggtccagcctggggggtccctgagactctcctgtgttgcctctgggttcacatttcgtaacaattggatgacctgggtccgccaggctccagggaaggggctggagtgggtggccaatataaaccgagatggaaataagatatactatgtggactctgttaagggccgattcaccatctccagagacaacgccaagagttcactgtttctgcaaatgagcagcctgagagccgaggacacggctctatattactgtacgagagatttcagcccctcccaaagtggaaattattatgatg

SEQ ID NO: 462425 - DNA, 527 bp, Homo sapiens
  misc_feature: HEFZJCU01A62OV.47.6.A06.1.454.heavy.3.raw
agctcacgtacacgaccggtgctcgatttagatctactgacagcacacaagggggggaaatactttctgagagtcctggacctcctgtgcaagaacatgaaacatctgtggttcttccttctcctggtggcagctcccacatgggtcctgtcccaggtgcagctgcaggagtcgggcccaggactggtgaagccttcggagaccctgtccctcacttgcactgtctctggtggctccatcaggagttactactggacctggcttcggcagtccccagggaagggactggagtggattgggtataattattacagtgggaccaccaactacaacccctccctcaagagtcgagtcaccatatcaatagacacgtcgaagaaccagttctccctgaagttgaactcagtgaccgctgcggacacggccgtgtattactgtgcgagccacaccgattacgatttttggagtggccttgataactggggccaggggatcctggtcaccgtctcctcacgcctccaccgacc

SEQ ID NO: 462426 - DNA, 493 bp, Homo sapiens
  misc_feature: HEFZJCU01CK2WV.22.86.H09.1.454.heavy.3.raw
acatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggctccgccaggctccgggcaaggggctggagtgggtggcaattatatggtatgatggaagtaataagactatgtggactccgtgaagggccgattcaccatctccagagacaactccaagaacactctgtttctccaaatgaaacagcctgagagggcgaggacacggcagtgtattactggtgcgagagatcgacatgactacggg

SEQ ID NO: 462427 - DNA, 518 bp, Homo sapiens; identical to SEQ ID NO: 451347
  misc_feature: HEFZJCU01D7W92.7.78.H01.1.454.heavy.3.raw

SEQ ID NO: 462428 - DNA, 513 bp, Homo sapiens
  misc_feature: HEFZJCU01B1UOA.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgtttcgatgccttcggtccgcgggtacttcgtggggtccagggaaccctc

SEQ ID NO: 462429 - DNA, 429 bp, Homo sapiens; identical to SEQ ID NO: 447944
  misc_feature: HEFZJCU01DYRJ0.4.37.D04.1.454.heavy.3.raw

SEQ ID NO: 462430 - DNA, 511 bp, Homo sapiens
  misc_feature: HEFZJCU01AVZFR.17.10.A10.1.454.heavy.3.raw
cgtagactagcacgaccggtgctcgatttagcgtcgatctcaggggtccgggagatcatgagggtgcccacgcccaggttcagttggtgcagactggggctgaggtgcagaagcctggggcatcagtgactgtctcctgcaaggccagtggatatatcttcacaaaatatggtatgaattggggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaatttgataggctctatggactggacttctgggggccagggggaccacggtgatcgtctcatcagcctccaccaaggggcccatcggtcttcccctggccaccctcctccaagagcacctcgg

SEQ ID NO: 462431 - DNA, 528 bp, Homo sapiens
  misc_feature: HEFZJCU01BBJHM.53.10.A10.1.454.heavy.3.raw
cgcgtatacacacgaccggtgctcgatttagcgtcgatctcaggggtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgccctccaggggggacctttggggtttcgacccctggggccaggggaaccctggtcaccgtctcctcagcctccaccaagggcccatcggtcttccccctggcaccctcctccaagagcacctcg

SEQ ID NO: 462432 - DNA, 313 bp, Homo sapiens; identical to SEQ ID NO: 445488
  misc_feature: HEFZJCU01CCA43.49.8.A08.1.454.heavy.3.raw

SEQ ID NO: 462433 - DNA, 536 bp, Homo sapiens
  misc_feature: HEFZJCU01DS19M.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggagggcctttcatgtctggggccaagggacgctggtcaccgtctcttcagcctccaccaaggcccatcggtcttcccctggcaccctcctccaacgagcacctctgggggcacagcc

SEQ ID NO: 462434 - DNA, 532 bp, Homo sapiens; identical to SEQ ID NO: 445228
  misc_feature: HEFZJCU01AOR9M.7.78.H01.1.454.heavy.3.raw

SEQ ID NO: 462435 - DNA, 499 bp, Homo sapiens
  misc_feature: HEFZJCU01D0VYZ.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctcctgaagctgagggctgtgagcgccgcagacacggccgtgtattactgtgcgagactggccgcaacagactcggtggcaactcctatcgcttttgatatcgtggggccaaggac

SEQ ID NO: 462436 - DNA, 511 bp, Homo sapiens
  misc_feature: HEFZJCU01B385C.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttccacccatcctccgggacagacttaccatgaccacgaacctcctccataaacacagcctacatggagttgaggagcctgacatctgacgacacggcctctattactgtgcgagagtcccacgactccggtgagcctacggcaggcggtcctttagacctttcgtc

SEQ ID NO: 462437 - DNA, 506 bp, Homo sapiens
  misc_feature: HEFZJCU01DSCCR.10.12.B01.1.454.heavy.3.raw
catagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatctgggggaggcgtggtccagccagggaggtccctgagactctcctgtgcagcctctggattgaggttcaataactatgctatgcactgggtccgccaggctccagggaaggggctggaatggatgacagttatttcacacgatgcaaccaaaacatactacgcggagttcgtgaggggccgctgcatcgtctccagagacaattcgaagaacactctgtacctgcaaatgaacagtctgagagccgaggacacggccgtctacttttgtgcgactagaagtgggagctataggggatttcg

SEQ ID NO: 462438 - DNA, 534 bp, Homo sapiens
  misc_feature: HEFZJCU01B5EN2.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaaccaggtggtccttacaatgaccaccatggaccctgtggacacagccacatatttctgtgcacactctataggagcacctggtagtctgccaaactggttcgacccctggggcccgggaaccctggtcaccgtctcctcagcctccaccacgggcccatcggtcttcccctc

SEQ ID NO: 462439 - DNA, 540 bp, Homo sapiens
  misc_feature: HEFZJCU01D649M.52.55.E11.1.454.heavy.3.raw
  modified_base (476)..(476): a, c, t, g, unknown or other
cgcagtacgacacgaccggtgctcgatttagcactcgcacgttgggtttggggaaccagattcctcctctaaagaagcccctgggagcacagctcatcaccatggactggacctggaggttcctctttgtggtggctgcagttacagctgtccagtcccaggtccacctggtgcagtctggggctgaagtaaagaagcctgggtcgtcggtgaaggtctcctgcagggcctctggagccaccttcggcacttatgggatcagctgggtgcgccaggcccctggacaagggcttgagtggatgggaagggtcatccctttctttgatttaacgaactacgcacagaaattccagggcagagtcaccattaccgcggacgaatccacgaccacagcctacatggagctgcgcaacctaagatctgacgacacggccgtgttttactgtgcgagatttacagtctcgcccacaacttcnggtggcggcggtgttcccaccttactacttttgactccgtggggccaggggaacccctggtccg

SEQ ID NO: 462440 - DNA, 472 bp, Homo sapiens; identical to SEQ ID NO: 445355
  misc_feature: HEFZJCU01EXO2A.4.37.D04.1.454.heavy.3.raw

SEQ ID NO: 462441 - DNA, 518 bp, Homo sapiens; identical to SEQ ID NO: 445423
  misc_feature: HEFZJCU01CQMOK.7.78.H01.1.454.heavy.3.raw

SEQ ID NO: 462442 - DNA, 507 bp, Homo sapiens
  misc_feature: HEFZJCU01A9XTZ.16.21.B10.1.454.heavy.3.raw
tgtactactccacgaccggtgctcgatttagtgtcgtcgcagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgacgaaagcaccggcagttagtcacccatactactttgactactgggg

SEQ ID NO: 462443 - DNA, 477 bp, Homo sapiens; identical to SEQ ID NO: 444659
  misc_feature: HEFZJCU01BN2TP.16.10.A10.1.454.heavy.3.raw

SEQ ID NO: 462444 - DNA, 529 bp, Homo sapiens
  misc_feature: HEFZJCU01EAPZM.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggcccggggaacctggtcaccgtctccccaccctccaccg

SEQ ID NO: 462445 - DNA, 495 bp, Homo sapiens; identical to SEQ ID NO: 445359
  misc_feature: HEFZJCU01EW0HF.4.21.B10.1.454.heavy.3.raw

SEQ ID NO: 462446 - DNA, 529 bp, Homo sapiens
  misc_feature: HEFZJCU01BZBIL.47.64.F09.1.454.heavy.3.raw
agctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcaccagttttaattattggtggggctggatccgccagcccccagggaaggggctggaatggattgggagtatattttataatggggacactctttacaacccatccctcaagagtcgagtttccatatccgcagacacgtccgagaatcacttctccctgaaactgagctctgtgaccgccgcagacacggctgtttattactgttcgagacatgccgaccgagagcattatcggcagttacggttttgattatttgggggccgaagggaccaaggggtccaccgtctccgcacgcctccaaccg

SEQ ID NO: 462447 - DNA, 501 bp, Homo sapiens
  misc_feature: HEFZJCU01BFRY2.53.80.H03.1.454.heavy.3.raw
cgcgtatacacacgaccggtgctcgatttagctgtgcgtcgaagggaaaggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacacgtccatcagcactgcctacatggagctgaccaggctgaaatttgaggtacacggccatttattactgtgcgaaggacagcataatgactccggtccccggtactttacg

SEQ ID NO: 462448 - DNA, 521 bp, Homo sapiens
  misc_feature: HEFZJCU01BCXLW.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccgggaaccctggtcaccgtctcccaccctccaccaagggcccatcggtcttcccctggcaccctcctccaagagcacctctgggggcacagcggcctggctgcctggtcaaggactactcccatactcgta

SEQ ID NO: 462449 - DNA, 499 bp, Homo sapiens; identical to SEQ ID NO: 458927
  misc_feature: HEFZJCU01D8OQJ.5.41.D08.1.454.heavy.3.raw

SEQ ID NO: 462450 - DNA, 519 bp, Homo sapiens; identical to SEQ ID NO: 446650
  misc_feature: HEFZJCU01CL2Q0.13.76.G10.1.454.heavy.3.raw

SEQ ID NO: 462451 - DNA, 482 bp, Homo sapiens; identical to SEQ ID NO: 444503
  misc_feature: HEFZJCU01B1F12.7.10.A10.1.454.heavy.3.raw

SEQ ID NO: 462452 - DNA, 524 bp, Homo sapiens
  misc_feature: HEFZJCU01B602I.48.4.A04.1.454.heavy.3.raw
agtatacatacacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcaagggcctggagtggattggggaaatcaatcatggtggatacaccaactacaacccgtccctcaagagccgagtcaccatcttagtggacacggcgaagaaccagttctccctgaactgaccgctgtgaccgccgcggacacggctgtgtattactgtgcgagacgaatgggcgggtggctacgacttgacttttggggcctagggaaacctggtcaccgtctccccagcttccaccaaggcccatcggtcttcccccg

SEQ ID NO: 462453 - DNA, 519 bp, Homo sapiens
  misc_feature: HEFZJCU01CYJZQ.9.64.F09.1.454.heavy.3.raw
tgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcaactggtggagtctgggggggggctggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaaggaggggggagtacgagtggcagctccaagtactactttgtacttctc

SEQ ID NO: 462454 - DNA, 513 bp, Homo sapiens
  misc_feature: HEFZJCU01CVTLV.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggtgaactactggggccagggcacctggtcaccgtctcctcagcttccaccaagggcccatcggtcttcccctggcgccctgctccaggagcacctctgggggtcacgagcggccctggggctggcctcggtcaaggactactttcccc

SEQ ID NO: 462455 - DNA, 492 bp, Homo sapiens
  misc_feature: HEFZJCU01BIKRE.19.53.E09.1.454.heavy.3.raw
tactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaaggcctggagtgggtctcaggtattagttggaatagtgctagtatagcctatgcggactctgtgaagggccgattcaccatctccagagacaacgccaagaactccctgtatctgcaaatgaacagtctgagagctgaggacacgggccttgtattactgtgcaagggaggtata

SEQ ID NO: 462456 - DNA, 523 bp, Homo sapiens
  misc_feature: HEFZJCU01EKP9W.4.35.D02.1.454.heavy.3.raw
agcactgtagcacgaccggtgctcgatttagcacacgatagttgggtttgggggggaaatactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtggctccatcagtaatttgtactggagctggatccggcagtcccaagggaagggactggagtgggttggatatatctttcacaccgggaccaccaactacaatccctccctcaagagtcgactcaccatgtcactggacacttccaagaaccagttctccctaaaattgacctctgtgagcgctgcagacacggccgtctattactgtgcgagactgcggggctattatggttcgggagatcccagtggttttgatatatggggccaggggacagcggtcaccgtctctttcag

SEQ ID NO: 462457 - DNA, 313 bp, Homo sapiens; identical to SEQ ID NO: 444518
  misc_feature: HEFZJCU01AGZGG.7.10.A10.1.454.heavy.3.raw

SEQ ID NO: 462458 - DNA, 500 bp, Homo sapiens; identical to SEQ ID NO: 445080
  misc_feature: HEFZJCU01APLLM.3.81.H04.1.454.heavy.3.raw

SEQ ID NO: 462459 - DNA, 496 bp, Homo sapiens
  misc_feature: HEFZJCU01A1H7F.17.86.H09.1.454.heavy.3.raw
cgtagactagcacgaccggtgctcgatttagtgctatagacttgggtttggggtctgggagaggagccccagccctgagattcccaggtgtttccattcagtgatcagcactgaacacagaggactcaccatggagttgggactgagctggattttccttttggctactctaaaaggtgtccagtgtgaagtgcagctggtggagtctgggggaggcttggtacagcctggcaggtccctgagactctcctgtgcagcctctggattcacctttgatgattatggcatgcactgggtccgccaagccccagggaagggcctggagtgggtctcaggcattagttggaatggtggtagcatagcctatgcggactccgtgaagggccgattcaccatctccagagacaacgccgaaattccctgtatctgcagatgaacagtctgagagctgaagacacggccttatatttctgtgtgaaaccatcacgccacaacg

SEQ ID NO: 462460 - DNA, 438 bp, Homo sapiens
  misc_feature: HEFZJCU01COA4F.3.21.B10.1.454.heavy.3.raw
agacgcactccacgaccggtgctcgatttagtgtcgtcgcaaggggccagtatctctacttacgagactgcttggaattggttcagactgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgtttattactgtgcaagagcgaggaggagcagttttgacagctggggccagggaaccctggtcaccggtctcctcagcctccaccaagggcccatcggtcttccccctggcgccctgctccaggagcacctccgagagcacagcggccctgggctgcctggtcaaggactacttccgagtgcgtct

SEQ ID NO: 462461 - DNA, 482 bp, Homo sapiens; identical to SEQ ID NO: 451792
  misc_feature: HEFZJCU01BYURY.19.71.G05.1.454.heavy.3.raw

SEQ ID NO: 462462 - DNA, 532 bp, Homo sapiens
  misc_feature: HEFZJCU01AL8UD.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgtctccttttactacctcccttgacttctggggccatcggaaccccggtccg

SEQ ID NO: 462463 - DNA, 504 bp, Homo sapiens
  misc_feature: HEFZJCU01EIMJ6.53.76.G10.1.454.heavy.3.raw
cgcgtatacacacgaccggtgctcgatttagtcactcatacagggggagtctccctcactgcccagctgggatctcagggcttcattttctgtcctccaccatcatggggtcaaccgccatcctcgccctcctcctggctgttctccaaggagtctgtgccgaggtgcagctggtgcagtctggaacagaggtgaaaagccgggggagtctctgaagatctcctgtaagggttctggatacaactttaccacctactggatcgcctgggtgcgccagatgcccggaaaaggcctggagtggatgggcatcgtcaatcctagtgactctgaagccacatacagcccgtccttccaaggccaggtcaccctctcagccgacaagtccatcagcgccgccttcctgcagtggcgcggcctggaggcctcgggacaccgccacatattactgtgcgagacttacatttgggggagttatcgttgttcctccactgggtgcttttgatt

SEQ ID NO: 462464 - DNA, 507 bp, Homo sapiens
  misc_feature: HEFZJCU01D8K8W.48.29.C07.1.454.heavy.3.raw
agtatacatacacgaccggtgctcgatttagagtgctacgaagggaaagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtggggccaagggacaatggtcaccgtcttcc

SEQ ID NO: 462465 - DNA, 512 bp, Homo sapiens
  misc_feature: HEFZJCU01EF2HU.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggtacttctggggccacgggaacctc

SEQ ID NO: 462466 - DNA, 325 bp, Homo sapiens
  misc_feature: HEFZJCU01DT2YK.18.17.B06.1.454.heavy.3.raw
tacgagtatgcacgaccggtgctcgatttagtcgatagtgaagggccgattcaccatctccagagacaattccaagaacacggtgtcaatggaaatgaacagcctgagagctgaggaacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagagcacagcggccctgggctgcctggtcaaggactacttcccatactcgta

SEQ ID NO: 462467 - DNA, 532 bp, Homo sapiens
  misc_feature: HEFZJCU01BEB3B.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgtagagcgtcgtctgtcagtggaattgactactggggccagggaaccctggtcaccgtctcctcagcctccaccaaggg

SEQ ID NO: 462468 - DNA, 481 bp, Homo sapiens; identical to SEQ ID NO: 448678
  misc_feature: HEFZJCU01A8OKA.7.10.A10.1.454.heavy.3.raw

SEQ ID NO: 462469 - DNA, 491 bp, Homo sapiens
  misc_feature: HEFZJCU01C9USU.11.13.B02.1.454.heavy.3.raw
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgcctgctccaggagcacctccgagagcacagcggcccgtgggctgcctggtcaaggactacttccgtatctctcg

SEQ ID NO: 462470 - DNA, 500 bp, Homo sapiens
  misc_feature: HEFZJCU01CTE11.13.33.C11.1.454.heavy.3.raw
  modified_base (472)..(472): a, c, t, g, unknown or other
tcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcataagaattgcaacgangctttgatatgtggggccaagggactac

SEQ ID NO: 462471 - DNA, 341 bp, Homo sapiens
  misc_feature: HEFZJCU01CZGPP.47.38.D05.1.454.heavy.3.raw
agctcacgtacacgaccggtgctcgatttagtatctgatagttgggtttcagggcagggtcacccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctggcctggtcaaggactacttcctacgtgagct

SEQ ID NO: 462472 - DNA, 526 bp, Homo sapiens
  misc_feature: HEFZJCU01BHOU2.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgagggccgattcaccatctccagagacaactctaagaacacgctgtttcttcaaatgaacagcctgagagccgatgacacggccgtgtattactgtgcgagagatggggcccacgaacgttactacgctatggacgtctggggccaagggaccacc

SEQ ID NO: 462473 - DNA, 533 bp, Homo sapiens
  misc_feature: HEFZJCU01BQ431.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactatacactgctccttttacaccttcccttgtactttcgtggggccatcggaaccccggtccg

SEQ ID NO: 462474 - DNA, 505 bp, Homo sapiens
  misc_feature: HEFZJCU01A4BG1.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaaccacgaactcctccataaacacagcctacatggagttgaggagcctgacatctgacgacacggccgtctattactgtgcgagagtcccacgatccggtgagcctaggcagccggcctttgactttctc

SEQ ID NO: 462475 - DNA, 521 bp, Homo sapiens
  misc_feature: HEFZJCU01BVKVX.49.20.B09.1.454.heavy.3.raw
agtcgagagacacgaccggtgctcgatttagtgtagtgtgaaggggacccaacaaccacatccctcctcagaagcccccagagcacaacgcctcaccatggactggacctggaggatcctctttttggtggcagcagccacaggtgcccactcccaggtccagcttgtgcagtctggggctgagttgaagaagcctggggcctcagtgagggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcaacggtcgtcatgggatttggactactggggccaggggaaccccggtcaccgtctcctctgcctccaaccg

SEQ ID NO: 462476 - DNA, 465 bp, Homo sapiens; identical to SEQ ID NO: 444805
  misc_feature: HEFZJCU01A5EUB.19.10.A10.1.454.heavy.3.raw

SEQ ID NO: 462477 - DNA, 492 bp, Homo sapiens
  misc_feature: HEFZJCU01C06KT.48.59.F04.1.454.heavy.3.raw
agtatacatacacgaccggtgctcgatttagtacacacacttagggattggggacccaacaaccacatccctcctcagaaggccccagagcacaactccgtaccatggactggacctggaggatcctctttttggtggcagcagccacaggtgcccactcccaggtccagcttgtgcaatctgggactgaactgaagaagcccgggggctctgtgagggtttcatgcaaggcctctggatactcgttcacaacctacactatgcattgggtgcgccaggcccccggacaaagccttgagtggatggggtggctcaacgctggcgatggtcagacaaagtattcacagaagttccagggcagagtcaccatcaccagggacacgtccgcgagtagtgtcttcatggagctgcgcagtctgagatcggaagacacggcagtatattactgtgcgagaggcggatatgtcgtcgaggtgactgctacagtcaaat

SEQ ID NO: 462478 - DNA, 490 bp, Homo sapiens; identical to SEQ ID NO: 446494
  misc_feature: HEFZJCU01BO1QK.11.13.B02.1.454.heavy.3.raw

SEQ ID NO: 462479 - DNA, 510 bp, Homo sapiens
  misc_feature: HEFZJCU01BJE89.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatccggtcttcccctggccgccctgcctccaggacg

SEQ ID NO: 462480 - DNA, 508 bp, Homo sapiens; identical to SEQ ID NO: 446002
  misc_feature: HEFZJCU01B8SJ9.9.78.H01.1.454.heavy.3.raw

SEQ ID NO: 462481 - DNA, 514 bp, Homo sapiens
  misc_feature: HEFZJCU01EC3LX.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggaggtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctggtggacagatcactggggccac

SEQ ID NO: 462482 - DNA, 499 bp, Homo sapiens
  misc_feature: HEFZJCU01DROH4.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgttctccaaatgaacagcctgagaggcgaggacacgggcagtgtattactgtgcgagagatcgacatgactacgggaaagcttttgatctctggggccaagggacactggtcaccgtctcttcagcctccaccaagggcccatcggtcctcccctggccgccctgc

SEQ ID NO: 462483 - DNA, 503 bp, Homo sapiens
  misc_feature: HEFZJCU01BJD7W.48.32.C10.1.454.heavy.3.raw
agtatacatacacgaccggtgctcgatttagtatagacatcaacacacaaagggggctttctgagagtcatggatcacatgtgcaagaaaatgaagcacctgtggttcttcctcctgctggtggcggctcccagatgggtcctgtcccaggtgcagctgcaggagtcgggcccaggactggtgaagccttcggagaccctgtccctcacgtgcactgtctctggtgactccatcaacaatagtcattactactggggctggatccgccagtccccagggaaggggctggagtggattggaattttatagcgggagcacctactataatccgtccctcaagagtcgagtcaccatatccgtagacacatccaagaaccagttctccctgaggctgagccctgtgaccgccgcagacacggctgtctattactgtgcgacccatcgatatcatgactggttgttagggcacgtctggggccaagggaccacggtcaccgtctcct

SEQ ID NO: 462484 - DNA, 514 bp, Homo sapiens
  misc_feature: HEFZJCU01BLYOK.48.26.C04.1.454.heavy.3.raw
agtatacatacacgaccggtgctcgatttagtctagcgactttgggtttggggggaagaggaagactgacggtccccccaggagttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagaagggtttactatggttcggggagtctccgacccagcaactggttcgaccctggggccagggaaccctggtcaccgtctcctcagcctccaccaagggcccatcggtcttcccctggcaccctcctccaagagcacctc

SEQ ID NO: 462485 - DNA, 491 bp, Homo sapiens
  misc_feature: HEFZJCU01CN9D5.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaatttatgcggactccgtgaacggtcgattcaccatctccagagacaattccaggaacacactgtttctgcaatgaacagcctgagaattgaggactcgggtatatactactgtgcccgtcgacccctgactgataaaccggactggtcgaccctgggccaggaacctgcaccgtctcct

SEQ ID NO: 462486 - DNA, 313 bp, Homo sapiens; identical to SEQ ID NO: 444518
  misc_feature: HEFZJCU01EVMN3.7.10.A10.1.454.heavy.3.raw

SEQ ID NO: 462487 - DNA, 519 bp, Homo sapiens
  misc_feature: HEFZJCU01CFK1F.10.53.E09.1.454.heavy.3.raw
catagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcgtcgggggaataccttcagcacgtggggccgac

SEQ ID NO: 462488 - DNA, 466 bp, Homo sapiens
  misc_feature: HEFZJCU01EFB9O.48.59.F04.1.454.heavy.3.raw
agtatacatacacgaccggtgctcgatttagtacacacacttagggattgggtagggattggggcagggtgtacacctgtggttctcggggctgccctttggctttggagatggttttctcgatgggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtgggccaagggacaatggtcaccgtctcttcagcctccaccaagggcccatcggtcttccccctggcaccctcctccaagagcacctctgggggcacagcggccctgggctgcctggtcaaggactacttcctatgtatact

SEQ ID NO: 462489 - DNA, 379 bp, Homo sapiens
  misc_feature: HEFZJCU01C3KSQ.47.77.G11.1.454.heavy.3.raw
agctcacgtacacgaccggtgctcgatttagctagtcactcaagggaaaggggctggagtgggtctcaggcattggtggtagtggtgccaggacacattacgcaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 462490 - DNA, 528 bp, Homo sapiens; identical to SEQ ID NO: 446252
  misc_feature: HEFZJCU01BXZZW.7.70.G04.1.454.heavy.3.raw

SEQ ID NO: 462491 - DNA, 491 bp, Homo sapiens; identical to SEQ ID NO: 445333
  misc_feature: HEFZJCU01AEFGD.19.53.E09.1.454.heavy.3.raw

SEQ ID NO: 462492 - DNA, 538 bp, Homo sapiens
  misc_feature: HEFZJCU01DENYO.19.10.A10.1.454.heavy.3.raw
tactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccagcccggggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaaatgaacagcctgaagaccgaggacacagccatttactattgtacaaatgaatactggggaacggggggaaaattggggaccagggaaccctggtctccgtctcgtcag

SEQ ID NO: 462493 - DNA, 509 bp, Homo sapiens
  misc_feature: HEFZJCU01EVIXK.48.60.F05.1.454.heavy.3.raw
agtatacatacacgaccggtgctcgatttagtacgtcatcagggaaagggggagagaggagccttagccctggattccaaggcctatccacttggtgatcagcactgagcaccgaggattcaccatggaactggggctccgctgggttatccttgttgctattttagaaggtgtccagtgtgaggtgcagctggtggagtcagggggaggcctggtcaagcctggggggtccctgagactctcctgtgcagcctctggattcaccttcagtacctataccatgaactgggtccgccaggctccagggaaggggctggagtgggtctcatccattagtagtagcagtaattatatagacgacgcagactcagtgaagggccgattcaccatctccagagacaacgccaagcactcactgtatctccaaatgaacagcctgagagccgacgacacggctgtcgtattactgtgcgagtactgggagagagtgggacctacgtgttcctacg

SEQ ID NO: 462494 - DNA, 510 bp, Homo sapiens
  misc_feature: HEFZJCU01BULT1.9.14.B03.1.454.heavy.3.raw
tgatacgtctcacgaccggtgctcgatttagtgtgagtagtttgggtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattacctttgacacttggggccagggaaccctggtcaccgtctcctcagcctccaccaagggcccatcggtcttcccctggcgccctgctccaggagcacctccgagagcacagcggccctgggctgcctggtcaaggactacttccagacgtatca

SEQ ID NO: 462495 - DNA, 400 bp, Homo sapiens
  misc_feature: HEFZJCU01AKF4P.13.61.F06.1.454.heavy.3.raw
tcacgtactacacgaccggtgctcgatttagctacgctctaagggaaaggggctggagtggttggcagtcatttcagatgatggcaatgataaatattacgcacgctccgtgaagggccgattcgccatctccagagacaattccaggaacacgctgtacctggagatggacggcctgagacctgacgacacggcaatttattactgtgcgagggtttatgtgttggaacgtggtacaccggaaaactggttcgacccctggggccagggaaccctggtcgtcgtctcgtctgcctccaccaagggccatcggtcttcccctggcgccctgctccaggagcacctccgagagcacagcggccctgggctgcctggtcaaggactacttcctagtacgtga

SEQ ID NO: 462496 - DNA, 518 bp, Homo sapiens
  misc_feature: HEFZJCU01BFNZ9.49.26.C04.1.454.heavy.3.raw
agtcgagagacacgaccggtgctcgatttagtctagcgactttgggtttgggacggtgttttcgagctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccggggaaggtctggagtgggtctctcttattaattgggatggtggtatcacctactatgcagactctgtgaaggggtcgattcaccatctccagagacaacagcagaaacctccctgtatctgcaaatgaacagtctcagaggtgaggacacccgccttcactactgtgacaaaaagattacgggtgacccacacctt

SEQ ID NO: 462497 - DNA, 527 bp, Homo sapiens
  misc_feature: HEFZJCU01BJLKC.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactactgggggttcgacccgtggggccagggaaccctggtcaccgtctcctcacgcctccaccg

SEQ ID NO: 462498 - DNA, 532 bp, Homo sapiens
  misc_feature: HEFZJCU01CVVSR.49.71.G05.1.454.heavy.3.raw
agtcgagagacacgaccggtgctcgatttagtgtcgtcgcaagagagaggggggagtctccttcaccacccagcggggatctcacggcttccttttctgtcctcctccaggatggggtcaaccgccatcctcgccctcctcctggctgttctccaaggagtctgtgccgaagtgcagctggtgcagcccggagcggtaatgaaaaagcccggggagtctctgaggatctcctgtaagggttctggatacagctttagtaccttctggatcacctgggtgcgccagctgcccgggaaaggcctggaatggatggggaggattgaccccagtgactccagtaccaactacagtccgtccttcgaaggccacgtcagcatctcacttgacgtgtccaccaccacctgtctacctacagtggcgcagcctcagacatcggacaccgccaccctattactgttgcacgacgccgttataccagaggctggtaccttgactcctggggccagggcaccctggtcaccgtctcctcacg

SEQ ID NO: 462499 - DNA, 527 bp, Homo sapiens
  misc_feature: HEFZJCU01D50AL.48.4.A04.1.454.heavy.3.raw
agtatacatacacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttctccctgaaactgaccgctgtgaccgccgcggacacggctgtgtattactgtgcgagacgaatgggcgggtggctacgacttgacttttggggccagggaaacctggtcaccgtctccccagcttccaccaacgggcccatcggtcttcccccg

SEQ ID NO: 462500 - DNA, 397 bp, Homo sapiens; identical to SEQ ID NO: 444534
  misc_feature: HEFZJCU01ANM0V.18.1.A01.1.454.heavy.3.raw

SEQ ID NO: 462501 - DNA, 518 bp, Homo sapiens
  misc_feature: HEFZJCU01C64FW.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaagggacaatggtcaccgtctcttcagcctccaccaagggcccatcggtcttcccccttggccaccctcctccaagagcacctctgggggcacagcggcccg

SEQ ID NO: 462502 - DNA, 394 bp, Homo sapiens; identical to SEQ ID NO: 444701
  misc_feature: HEFZJCU01B7V4F.3.12.B01.1.454.heavy.3.raw

SEQ ID NO: 462503 - DNA, 483 bp, Homo sapiens
  misc_feature: HEFZJCU01CNT02.19.53.E09.1.454.heavy.3.raw
tactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaaggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagca

SEQ ID NO: 462504 - DNA, 488 bp, Homo sapiens; identical to SEQ ID NO: 444617
  misc_feature: HEFZJCU01E04WE.4.6.A06.1.454.heavy.3.raw

SEQ ID NO: 462505 - DNA, 521 bp, Homo sapiens
  misc_feature: HEFZJCU01B0N8J.48.4.A04.1.454.heavy.3.raw
agtatacatacacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccactacaacccgtccctcaagagccgagtcaccatcttagtggacacggcgaagaaccagttctccctgaaactgaccgctgtgaccgccgcggacacggctgtgtattactgtgcgagacgaatgggcgggtggctacgacttgacttttggggccagggaaacctggtcaccgtctcccagcttccaccaggcccatcggtcttccccg

SEQ ID NO: 462506 - DNA, 529 bp, Homo sapiens
  misc_feature: HEFZJCU01BEE38.8.34.D01.1.454.heavy.3.raw
ctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtagtactactgttacgaagggaggggggaaccgaggacgggagttaccaagtactcctttcgg

SEQ ID NO: 462507 - DNA, 536 bp, Homo sapiens
  misc_feature: HEFZJCU01BAXMS.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccggggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttggaggggcctttcatgtctgggccaagggacgctggtcaccgtctcttcagcctccaccaagggcccatcggtcttcccctggcaccctcctccaagagcacctctgggggcacagcc

SEQ ID NO: 462508 - DNA, 501 bp, Homo sapiens; identical to SEQ ID NO: 445341
  misc_feature: HEFZJCU01C8AKQ.48.34.D01.1.454.heavy.3.raw

SEQ ID NO: 462509 - DNA, 488 bp, Homo sapiens
  misc_feature: HEFZJCU01CVW46.19.82.H05.1.454.heavy.3.raw
tactctcgtgcacgaccggtgctcgatttagtcgagctctctcgcgggggcatcactcaacaaccacatctgtcctctagagaaaaccctgtgagcacagctcctcaccatggactgggcctggaggatcctcctcttggtggcagcagctacaagtgcccactcccaggtgctactggtgcagtctggggctgaggtgaagaggcctggggcctcagtgaaggtctcctgcaagacttctgggttccccttccaaaattttgatatcaattgggtgcgacaggccactggacaagggctcgagtggatgggatggatgaacggtaaaagtggaaacacaggctatgcggagagattccagggcagagtcaccatgactggggacccctctgtcggcacagcctacatggagctgagaagtctgacacctgaggacacggccgtctattactgtgcgagagccgcgaatatgaagtgcggagatggta

SEQ ID NO: 462510 - DNA, 397 bp, Homo sapiens; identical to SEQ ID NO: 444534
  misc_feature: HEFZJCU01A587H.18.1.A01.1.454.heavy.3.raw

SEQ ID NO: 462511 - DNA, 495 bp, Homo sapiens
  misc_feature: HEFZJCU01A18BK.4.57.F02.1.454.heavy.3.raw
agcactgtagcacgaccggtgctcgatttagctcgatatagttgggtttgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttccccctggccgccctgctccaggagcacctctgggggcacagcggccctgggctgcctggtcaaggactaccttccctacacgtgct

SEQ ID NO: 462512 - DNA, 490 bp, Homo sapiens
  misc_feature: HEFZJCU01B6V7Z.49.34.D01.1.454.heavy.3.raw
agtcgagagacacgaccggtgctcgatttagatcgtctgtgttgggtttgggggctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctggggaggtccctgagactctcttgtgcagcctctggattcaccttcagggtctatgacatgcactgggtccgccaggctccaggcaaggggctggagtgggtggcagttatatcatatgatggaagcaaagatatactatgtagactccgtgaagggccgattcatcatctccagagacaactccgagaacacgctgtatctgacaaatgaacaggctgagaggctggaagacacggctgtatatttactgtgacgtaaa

SEQ ID NO: 462513 - DNA, 513 bp, Homo sapiens
  misc_feature: HEFZJCU01BYU7S.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctctagaacacactgtctcttcaaatgaacagcctgaggccgaggacacggccgtctattattgtgtgagagtttatggcgatggctggtggactagatcactggggcca

SEQ ID NO: 462514 - DNA, 503 bp, Homo sapiens
  misc_feature: HEFZJCU01DM3LF.4.58.F03.1.454.heavy.3.raw
agcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaaagccttgagtggatgggatcgatcaactctggcaatggcaacacaaaatattcacagaagttacagggcagagtcaccattaccagggacacatccgcgaacacagcctacatggagctgagcagcctgacatctgaagacacggctgtgtatttactgttcgaggacgggctagtctgggatctagttatagtgactcgtcgttctggggcc

SEQ ID NO: 462515 - DNA, 484 bp, Homo sapiens; identical to SEQ ID NO: 446564
  misc_feature: HEFZJCU01CUASW.19.13.B02.1.454.heavy.3.raw

SEQ ID NO: 462516 - DNA, 518 bp, Homo sapiens
  misc_feature: HEFZJCU01CCAQN.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctctgggggcacagcggccctgggctgcctggtcaaggactactctacgtagacacgacgctgcgggccggtcggtcggacggacggccacta

SEQ ID NO: 462517 - DNA, 483 bp, Homo sapiens; identical to SEQ ID NO: 444924
  misc_feature: HEFZJCU01EHWY6.10.35.D02.1.454.heavy.3.raw

SEQ ID NO: 462518 - DNA, 499 bp, Homo sapiens; identical to SEQ ID NO: 447792
  misc_feature: HEFZJCU01BZBMN.17.10.A10.1.454.heavy.3.raw

SEQ ID NO: 462519 - DNA, 505 bp, Homo sapiens
  misc_feature: HEFZJCU01B9HI6.15.55.E11.1.454.heavy.3.raw
tctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtgaaaacacatattacgcaggctccgtgaagggccgcttcaccatctccagagacaattccaacaacacactttatcttcaaatgaacagcctgcgagccgaggacacggccgtatactactgtgcgagagatcgaacaggcccgtgggagcccgttgactactggggccagggaaccctggtcaccgtctcctcaacctccaccaagggcccatcggtcttcccctggcaccctcctccaagagcacctctgggggcacagcggccctgggcctgcctggtaacaggactacttccgctacgtaga

SEQ ID NO: 462520 - DNA, 505 bp, Homo sapiens
  misc_feature: HEFZJCU01BZH0I.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtctgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttcgtgggccac

SEQ ID NO: 462521 - DNA, 491 bp, Homo sapiens
  misc_feature: HEFZJCU01ECEWM.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccaggaaggggctggaatgggtctcatctattagtgctactactggtggcacatacttcgcagactccgtgaagggccggttctccatctccagagacaattccaagaacacgctgtatctgcaattgaacagcctgagagccgaggacacggccgtatattactgtgcgaaagatttggggaatgaccactc

SEQ ID NO: 462522 - DNA, 483 bp, Homo sapiens; identical to SEQ ID NO: 444932
  misc_feature: HEFZJCU01CQLJ1.7.10.A10.1.454.heavy.3.raw

SEQ ID NO: 462523 - DNA, 524 bp, Homo sapiens
  misc_feature: HEFZJCU01A5KSM.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacggcttctacttctgtgcgaggagtaattactataacactgctccttttacacctcctgacttctgggccatggaacccggtccg

SEQ ID NO: 462524 - DNA, 499 bp, Homo sapiens
  misc_feature: HEFZJCU01D2ZXO.51.78.H01.1.454.heavy.3.raw
cgatcgtatacacgaccggtgctcgatttagtgtgagtagtttggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgctactggtggagtctgggggaggcctggtacagcctggcaggtccctgagactctcctgtgcagcctctggattcacctttgatgattatgccatgcactgggtccggcaagctccgagggaagggcctggagtgggtctcacgtattagttggaataggtggtagtatagcctatgcggactctgtgaagggccgattcaccatctccagagacaacgccaagaacctccctgtatctgacaaatgaacagtctgagagctgaggacacggccttgtattactgcgacaaaagccaaggcaac

SEQ ID NO: 462525 - DNA, 396 bp, Homo sapiens; identical to SEQ ID NO: 444469
  misc_feature: HEFZJCU01D4LP3.47.46.E02.1.454.heavy.3.raw

SEQ ID NO: 462526 - DNA, 491 bp, Homo sapiens
  misc_feature: HEFZJCU01BKHGL.53.38.D05.1.454.heavy.3.raw
cgcgtatacacacgaccggtgctcgatttagtatctgatagttgggtttggggacccaacaaccacatccctcctcagaagcccccagagcacaacgcctcaccatggactggacctggaggatcctctttttggtggcagcagccacaggtgcccactcccaggtccagcttgtgcagtctggggctgaggcgaagaagcctggggcctcagtgaaggtttcctgccaggcttctggatacaccctcagtacccatgctatccattgggtgcgccaggcccccggacaaagacttgagtggatgggatggatcagcgctggcaatggtgacagacactattcacagaagttccagggcagagtcaccatcaccagggacacatccgcgagcacagcctacatggaactgagcagcctgagatctgaagacacgggtgtatattactgtgcgagagggaagtgggatagttgtagatgcgccaggtgcccc

SEQ ID NO: 462527 - DNA, 535 bp, Homo sapiens
  misc_feature: HEFZJCU01CKK17.49.78.H01.1.454.heavy.3.raw
agtcgagagacacgaccggtgctcgatttagtgtgagtagtttgggtttggggacccaacaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcaacggtcgtcatgggatttggacttacgtgggggccagggggaacccccggtcgacccgtctccgtctgcctccaccg

SEQ ID NO: 462528 - DNA, 534 bp, Homo sapiens
  misc_feature: HEFZJCU01BQT2I.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggatacagtggcagctccaagtactactttgacttctgggggccagggaaccctggtcgaccgtctcctcacgcctccaccaagggccccatcggtcttccccctggcgccctgctcctacggagcacctccgagacg

SEQ ID NO: 462529 - DNA, 379 bp, Homo sapiens; identical to SEQ ID NO: 444450
  misc_feature: HEFZJCU01DLJDP.47.77.G11.1.454.heavy.3.raw

SEQ ID NO: 462530 - DNA, 490 bp, Homo sapiens
  misc_feature: HEFZJCU01EDYI9.51.52.E08.1.454.heavy.3.raw
cgatcgtatacacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagcctggggcctcagtgaaggtctcctgcaagacttctggatacaccttcaccgactactatatgcactgggtgcgacaggcccctggacaagggcttgagtggatgggatggatcgaccctaagaatggtgccacaaactatgcacagactttcagggctgggtcaccatgaccagcgacacatctagcaacacagtctacatggagttgaaccagcctgaccgacacggccgtgtatttttgtgttgagagtattttcggactaatccagagacccct

SEQ ID NO: 462531 - DNA, 500 bp, Homo sapiens; identical to SEQ ID NO: 444529
  misc_feature: HEFZJCU01COZ4Z.12.38.D05.1.454.heavy.3.raw

SEQ ID NO: 462532 - DNA, 514 bp, Homo sapiens; identical to SEQ ID NO: 451530
  misc_feature: HEFZJCU01AKNRW.13.76.G10.1.454.heavy.3.raw

SEQ ID NO: 462533 - DNA, 520 bp, Homo sapiens
  misc_feature: HEFZJCU01BMVNQ.16.21.B10.1.454.heavy.3.raw
  modified_base (137)..(137): a, c, t, g, unknown or other
  modified_base (464)..(464): a, c, t, g, unknown or other
tgtactactccacgaccggtgctcgatttagtgtcgtcgcaggagagaggagcccagccctgggattttcaggtgttttcatttggtgatcaggactgaacagagagaactcaccatggagtctgggctgagcgtgngtttctaggtggctattttaaaaggtgtccagtgtgaggtgcagctgttggagtctgggggaggcttggcacagcctggggggtccctgagactctcctgtgcagcctctggattcaccttttgacagctatgccatgacctgggtccgccaggctccagggaaggggctgggaatgggtctcaggtattaactggtggtggttataccacatactacgcagactccgtgaaggggccggttcaccatctccagagacaattcccaagaacacactgtatctgcaaatgaacagcctgagagccgacgacacgggccatatattacngttgcgaaaagcaaccggcagttagtcacccatacctactttgactactggggccg

SEQ ID NO: 462534 - DNA, 511 bp, Homo sapiens
  misc_feature: HEFZJCU01EPAY1.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaagggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccaac

SEQ ID NO: 462535 - DNA, 501 bp, Homo sapiens; identical to SEQ ID NO: 457766
  misc_feature: HEFZJCU01BNNX5.11.27.C05.1.454.heavy.3.raw

SEQ ID NO: 462536 - DNA, 497 bp, Homo sapiens
  misc_feature: HEFZJCU01EHHFJ.40.35.D02.1.454.heavy.3.raw
tctagcgactcacgaccggtgctcgatttagcacacgatagttgggtttgggggaggcttggtacagcctggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcaggaagtgggagctggtaggcctcaatactggggccgggaatcctggtcaccgtctcctcagcctccaccaagggcccatcggtcttcccctggcgccctgctccaggagcacctccgagagtacagcggccctggggctgcctggtcaaggactacttccagtcgctaga

SEQ ID NO: 462537 - DNA, 514 bp, Homo sapiens
  misc_feature: HEFZJCU01EMIUK.7.71.G05.1.454.heavy.3.raw
cgtgtctctacacgaccggtgctcgatttagtgtcgtcgcaagagagagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccaggcgggagttccaagtactcctttg

SEQ ID NO: 462538 - DNA, 529 bp, Homo sapiens
  misc_feature: HEFZJCU01D8DVK.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaagtaatggctgtgtttattggggccagggagccctggt

SEQ ID NO: 462539 - DNA, 507 bp, Homo sapiens
  misc_feature: HEFZJCU01CXCNL.40.31.C09.1.454.heavy.3.raw
tctagcgactcacgaccggtgctcgatttagacgtctcatcaaggaaggaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctctttgatgccttttgatatgtggggccaagggacaatggtcaccgtctcttcagcctccaccg

SEQ ID NO: 462540 - DNA, 450 bp, Homo sapiens; identical to SEQ ID NO: 444893
  misc_feature: HEFZJCU01EQ0U1.53.57.F02.1.454.heavy.3.raw

SEQ ID NO: 462541 - DNA, 524 bp, Homo sapiens
  misc_feature: HEFZJCU01C2ZJH.10.53.E09.1.454.heavy.3.raw
catagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggagcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcgggggcccgattcaccatctccaaagacaatttgaagaacacgctgtttctgcaaactgaacagcctgagagctgaggacgacggctgtgtattactgttcgtttggtttctgtacgtgtcggggggaataccgttctagcactgggccgac

SEQ ID NO: 462542 - DNA, 390 bp, Homo sapiens; identical to SEQ ID NO: 444541
  misc_feature: HEFZJCU01BLARX.16.24.C02.1.454.heavy.3.raw

SEQ ID NO: 462543 - DNA, 524 bp, Homo sapiens; identical to SEQ ID NO: 445902
  misc_feature: HEFZJCU01DWPLE.9.78.H01.1.454.heavy.3.raw

SEQ ID NO: 462544 - DNA, 513 bp, Homo sapiens
  misc_feature: HEFZJCU01DWNHK.15.73.G07.1.454.heavy.3.raw
tctacgtagccacgaccggtgctcgatttagctctacgctcagggtcttcgtggctcacgtccaccaccacgcatgtgacctcaggggtccctgagactctcctgtgcagcctctggattcgtctttagcagctatgccatgagctgggctcgccaggctccagggaaggggctggagtgggtctctgctattcctggcagtggtgatatcgaatactacgcagactccgtgaagggccggttcactgtttccagagacaattccaagaacacactgtatctgcagatgaccagcctgagagccgaggacacggccgtatattactgtgcgaaacgccaagatttttggagtggttattatacctttgactcttggggccagggaaccctggtcaccgtctcctcagcctccaccaagggcccatcggtcttccccctggcaccctcctccaagagcacctctgggggcacagcgaccctgggctgcctggtcaaggactacttccgctacgt

SEQ ID NO: 462545 - DNA, 513 bp, Homo sapiens
  misc_feature: HEFZJCU01A92A8.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttccccctggcgccctgctccaggagccacctccgagagcacagcggccctggg

SEQ ID NO: 462546 - DNA, 519 bp, Homo sapiens; identical to SEQ ID NO: 458420
  misc_feature: HEFZJCU01DKX9J.12.86.H09.1.454.heavy.3.raw

SEQ ID NO: 462547 - DNA, 528 bp, Homo sapiens
  misc_feature: HEFZJCU01EVYCZ.51.37.D04.1.454.heavy.3.raw
cgatcgtatacacgaccggtgctcgatttagtagcatactgttgggtttggggagctctgagagaggagcccagccctgggattttcaggtgttttcatttggtgatcaggactgaacagagagaactcaccatggagtttgggctgagctggctttttcttgtggctattttaaaaggtggccagtgtgaggtgcagctgttagagtctgggggaggcttggtccagcctggggggtccctcagactctcctgtgcagcctcgggaattatatttaagaactttgccatgagttgggtccgccaggctccagggaaggggctggaatgggtctccactattagtggcagcggtgatgacacattctacacagactccgtgaggggccgtttcaccatctccagagacaatgccaaagacacgctctatctggaagtgaaagagcctgagagtcgaggacacggccgtcttttattgtgtgaaggggcgtgggacttagttcttcaggaccagtatttactttgtacc

SEQ ID NO: 462548 - DNA, 507 bp, Homo sapiens
  misc_feature: HEFZJCU01DFQCN.9.78.H01.1.454.heavy.3.raw
tgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctcaggagcacctccgagagcacagcggccctgggctgcctggtcaaggactacttccagacgtatca

SEQ ID NO: 462549 - DNA, 496 bp, Homo sapiens
  misc_feature: HEFZJCU01CUBT1.53.80.H03.1.454.heavy.3.raw
cgcgtatacacacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacacgtccatcagcactgcctacatggagctgaccaggctgaaatttgaggacacggccatttattactgtgcaaggaacagcataatgactcgtccccgactttcg

SEQ ID NO: 462550 - DNA, 515 bp, Homo sapiens
  misc_feature: HEFZJCU01BBCIV.52.81.H04.1.454.heavy.3.raw
cgcagtacgacacgaccggtgctcgatttagtagtgtagattcgcggggtctgagagaggagcccagccctgggattttcaggtgttttcatttggtgatcaggactgaacagagagaactcaccatggagtttgggctgagcgtggcgttttctaggtggctattttaaaaggtgtccagtgtgaggtgcagctgctgcagtcggggggaggcttggtacagcctggggggtccctgagactctcctgtgcagcctctggattcacctttcgcgtctatgacatgagctgggtccgccaggctccaggaatggggctggagtgggtctcaggtattaatagtggtggaagtacatattacgcagactccgtgaagggccgcttcaccatctccagagacaattccaagaacacactgtatctgcaaatgaacagcctgagagccgaggacacggccacctatttctgtaacgaaagaactacacacagccgtggacgaggagccaaacgggccg

SEQ ID NO: 462551 - DNA, 514 bp, Homo sapiens
  misc_feature: HEFZJCU01CUDUG.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttctcaaatgaacagcctgagagccgatgacacggccgtgtattactgtgcgagagatggggcccacgaacgttactacgctatggacgtctggggaccg

SEQ ID NO: 462552 - DNA, 519 bp, Homo sapiens
  misc_feature: HEFZJCU01D5JHF.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctgggccagggaaccctggtcaccgtctcctcagcctccaccaagggcccatcggtcttcccctggcaccctcctccaagagcacctctgggggcacagcggccctgggctgcctggtcaaggactacttccgagtagtactac

SEQ ID NO: 462553 - DNA, 500 bp, Homo sapiens; identical to SEQ ID NO: 444529
  misc_feature: HEFZJCU01BUB4J.12.38.D05.1.454.heavy.3.raw

SEQ ID NO: 462554 - DNA, 483 bp, Homo sapiens; identical to SEQ ID NO: 444532
  misc_feature: HEFZJCU01DM1PJ.47.59.F04.1.454.heavy.3.raw

SEQ ID NO: 462555 - DNA, 519 bp, Homo sapiens; identical to SEQ ID NO: 448643
  misc_feature: HEFZJCU01ESJ7H.9.34.D01.1.454.heavy.3.raw

SEQ ID NO: 462556 - DNA, 486 bp, Homo sapiens; identical to SEQ ID NO: 448316
  misc_feature: HEFZJCU01BH3HX.3.48.E04.1.454.heavy.3.raw

SEQ ID NO: 462557 - DNA, 395 bp, Homo sapiens; identical to SEQ ID NO: 446634
  misc_feature: HEFZJCU01CLBAX.10.42.D09.1.454.heavy.3.raw

SEQ ID NO: 462558 - DNA, 477 bp, Homo sapiens; identical to SEQ ID NO: 444659
  misc_feature: HEFZJCU01A0MV0.16.10.A10.1.454.heavy.3.raw

SEQ ID NO: 462559 - DNA, 525 bp, Homo sapiens
  misc_feature: HEFZJCU01EVVFA.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggatacagtggcagctccaagtactactttgacttctggggccagggaaccctggtcaccgtctcctcagcctccaccaacgggcccagtcgtcttcccctggccgccctgcctccaggacgcacctccg

SEQ ID NO: 462560 - DNA, 516 bp, Homo sapiens
  misc_feature: HEFZJCU01AST90.11.72.G06.1.454.heavy.3.raw
  modified_base (446)..(446): a, c, t, g, unknown or other
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcacactggaagcagagtctatgcggagagattccgagggtcaggagtcaccctgaccacagagacatccacgaccacagtctacatggagctgtggagcctgagacctgacgacacggccctntattactgtgcgacggccctagtcctacagtcgaccactccacgctgggttccgacctctggggcctaac

SEQ ID NO: 462561 - DNA, 534 bp, Homo sapiens
  misc_feature: HEFZJCU01CTU2G.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacatccctgaaagcgtcaactactactactacggtatggacctctggggaccg

SEQ ID NO: 462562 - DNA, 526 bp, Homo sapiens
  misc_feature: HEFZJCU01DUB52.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccaccctccaccaagggcccatcggtcttccccctggcaccctcctccaagagcacctctgggggcacagcggcctgggctgcctggtcaaggactacttcccatactcgta

SEQ ID NO: 462563 - DNA, 510 bp, Homo sapiens
  misc_feature: HEFZJCU01BRNNS.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgttgtttggccggtgaactactggggccagggcaccctggtcaccgtctcctcagcttccaccaagggcccatcggtcttcccctggcgccctgctccaggagcacctctgggggcacagcggccctgggctgcctggtcaaggactacttcccatac

SEQ ID NO: 462564 - DNA, 522 bp, Homo sapiens
  misc_feature: HEFZJCU01C90MV.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgtctggggccaggggaccctggtcatcgtctccccagcctccaccaagggcccatcggtcttccccctggccg

SEQ ID NO: 462565 - DNA, 515 bp, Homo sapiens
  misc_feature: HEFZJCU01DIZT8.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaaccctggtcgccgtctcctcagcctccaccaaggccatcggtcttcccctggcaccctcctccaagagcacctctgggggcacagcggccctgggctgcctggtcaaggactacttccagacgtatca

SEQ ID NO: 462566 - DNA, 517 bp, Homo sapiens
  misc_feature: HEFZJCU01B85N9.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaaggcccatcggtcttcccctggcaccctcctccaagagcacctctgggggcacacgcggccctgggctgcctggtcaaggactacttctagagacacg

SEQ ID NO: 462567 - DNA, 532 bp, Homo sapiens
  misc_feature: HEFZJCU01DU6E9.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaaccaggtggtccttacaatgaccaccatggaccctgtggacacagccacatatttctgtgcacactctataggagcacctggtagtctgccaaactggttcgacccctggggcccggaacctggcaccgtctcctcacgcctccaccaagggcccatcggtcttcccctc

SEQ ID NO: 462568 - DNA, 496 bp, Homo sapiens
  misc_feature: HEFZJCU01EOPS8.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaaccaggtggtccttacaatgaccaacatggaccctgtggacacagccacatattactgtgcacagagatacgggcagcacgtggtttggggctacgtggggccagggaaccctggtcaccgtctcctcagcctccacc

SEQ ID NO: 462569 - DNA, 511 bp, Homo sapiens
  misc_feature: HEFZJCU01BZHHQ.51.12.B01.1.454.heavy.3.raw
cgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcagggtcagtcatgaccggggacgacgtccatcgccacaacttacatggaactgaccagtctgacatttgacgacacggcgtctattactgtgcgacagaagcggcggacagaggttcgcttactggttcgaggctctccccacg

SEQ ID NO: 462570 - DNA, 506 bp, Homo sapiens; identical to SEQ ID NO: 444732
  misc_feature: HEFZJCU01DXUH6.14.78.H01.1.454.heavy.3.raw

SEQ ID NO: 462571 - DNA, 500 bp, Homo sapiens; identical to SEQ ID NO: 445807
  misc_feature: HEFZJCU01BJILI.40.81.H04.1.454.heavy.3.raw

SEQ ID NO: 462572 - DNA, 475 bp, Homo sapiens
  misc_feature: HEFZJCU01DVJQL.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaagggctggagtgggtctcaactttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctctggggcacagcggcctgggctgcctggtcaaggactacttccgagtagtaca

SEQ ID NO: 462573 - DNA, 524 bp, Homo sapiens
  misc_feature: HEFZJCU01D7BN1.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcattacttgaccctggggccggggaaccctggtcaccgtctccccaccctccaccaagggcccatcggtcttcccctggcaccctcctccaagagcacctctgggggcacagcggccctgggctgcctggtcaaggactacttcccatactcgta

SEQ ID NO: 462574 - DNA, 507 bp, Homo sapiens; identical to SEQ ID NO: 453371
  misc_feature: HEFZJCU01B5AXZ.11.13.B02.1.454.heavy.3.raw

SEQ ID NO: 462575 - DNA, 493 bp, Homo sapiens
  misc_feature: HEFZJCU01D7II4.11.81.H04.1.454.heavy.3.raw
  modified_base (480)..(480): a, c, t, g, unknown or other
  modified_base (485)..(485): a, c, t, g, unknown or other
cgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcgtggtttcgtcgttaggctctttaagtaggtgtccagtgtcaggtgcaactggtggagtctgggggaggcgtggtccagcctgggaggtccctgagactctcctgtgcagcgtctggattcaccttcaggagctatgacatgcactgggtccgccaggctccaggcaaggggctggagtgggtggcagttatatggtatgatggaagttataaatactatggagactccgtgaaggccgattcaccatctccagagacacttccaagaacacggtgtatctgcaaatgaacagcctgagngccgnggacacgg

SEQ ID NO: 462576 - DNA, 504 bp, Homo sapiens
  misc_feature: HEFZJCU01B3YEH.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctgggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgacttctc

SEQ ID NO: 462577 - DNA, 510 bp, Homo sapiens
  misc_feature: HEFZJCU01B1MPN.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggcgcctgctccaggagcactctggggcacagcgcccg

SEQ ID NO: 462578 - DNA, 400 bp, Homo sapiens; identical to SEQ ID NO: 444452
  misc_feature: HEFZJCU01B1QBE.47.24.C02.1.454.heavy.3.raw

SEQ ID NO: 462579 - DNA, 528 bp, Homo sapiens
  misc_feature: HEFZJCU01AFBVR.7.70.G04.1.454.heavy.3.raw
  modified_base (408)..(408): a, c, t, g, unknown or other
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctcngtttgacagccgcggacacgggcgtttattactgtgcgagagggacggactacggtgactactgggggttcgaccccgtggggccagggaacctggtcaccgtctcctcagcctccaccg

SEQ ID NO: 462580 - DNA, 398 bp, Homo sapiens
  misc_feature: HEFZJCU01AH88Y.18.1.A01.1.454.heavy.3.raw
tacgagtatgcacgaccggtgctcgatttagacgtctcatcgaaggaaggaaggggctggagtggatttcatacattagtagtgcctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactggggccagggcactccggtcaccgtctcctcagcctccaccaagggcccatcggtcttccccctggcaccctcctccaggagcacctccgagagcacagcggccctgggctgcctggtcaaggactacttcccatactcgta

SEQ ID NO: 462581 - DNA, 519 bp, Homo sapiens
  misc_feature: HEFZJCU01B4QWI.52.68.G02.1.454.heavy.3.raw
cgcagtacgacacgaccggtgctcgatttagtcgatagtgaagggaaaggggagctctgggagacgagcccagcactggaagtcgccggtgtttccattcggtgatcatcactgaacacagaggactcaccatggaatttgggctgacttgggttttcctcgttgctcttttaagaggtgtccagtgtcaggtgcaactggtggagtctgggggaggcgtggtccagcctgggaggtccctgagactctcctgtgtcgcctctggattcaccttcagtatttatggcatttattgggtccgtcaggctccaggcaaggggctggaatgggtggcctttatttcatatgatggaaccaataaagcctacactgactccgtgaagggccgattcacccatctcccgagacaattccaagaacacactctatctgcaaatgaacagcctgagacatgaggacacggctgtttactcttgtgcgagaattgccctctttagggggccctttggacaactgggg

SEQ ID NO: 462582 - DNA, 400 bp, Homo sapiens
  misc_feature: HEFZJCU01CK7Q9.16.72.G06.1.454.heavy.3.raw
tgtactactccacgaccggtgctcgatttagctacgactgcaagggaaaggggctggagtgggtctcatctattagtagtagtgatagtgccacatactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 462583 - DNA, 511 bp, Homo sapiens; identical to SEQ ID NO: 452200
  misc_feature: HEFZJCU01BVQ10.16.71.G05.1.454.heavy.3.raw

SEQ ID NO: 462584 - DNA, 525 bp, Homo sapiens
  misc_feature: HEFZJCU01EA8E7.51.26.C04.1.454.heavy.3.raw
  modified_base (523)..(523): a, c, t, g, unknown or other
cgatcgtatacacgaccggtgctcgatttagtctagcgactttgggtttggggctgggagacgagcccagcactggaagtcgccggtgtttccattcggtgatcatcactgaacacagacatggagtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttaattctgtgtgcgatccgacctcacgttggggtaacggggagtttaccttcctccgactaacggtntc

SEQ ID NO: 462585 - DNA, 514 bp, Homo sapiens; identical to SEQ ID NO: 447144
  misc_feature: HEFZJCU01DF09S.17.33.C11.1.454.heavy.3.raw

SEQ ID NO: 462586 - DNA, 531 bp, Homo sapiens; identical to SEQ ID NO: 459801
  misc_feature: HEFZJCU01BWXOW.18.33.C11.1.454.heavy.3.raw

SEQ ID NO: 462587 - DNA, 498 bp, Homo sapiens; identical to SEQ ID NO: 449824
  misc_feature: HEFZJCU01BPO4W.47.38.D05.1.454.heavy.3.raw

SEQ ID NO: 462588 - DNA, 379 bp, Homo sapiens; identical to SEQ ID NO: 444450
  misc_feature: HEFZJCU01B6XID.47.77.G11.1.454.heavy.3.raw

SEQ ID NO: 462589 - DNA, 520 bp, Homo sapiens
  misc_feature: HEFZJCU01EITZH.51.31.C09.1.454.heavy.3.raw
  modified_base (513)..(513): a, c, t, g, unknown or other
cgatcgtatacacgaccggtgctcgatttagacgtctcatcaaggaaggaaggggagctctgagagaggagcccagccctgggattttcaggtgttttcatgtggtgatcaggactgaacagagagaactcaccatggagtctgggctgacgtggctttttcttgtggctattttaaaaggtgtccagtgtgacgtgcagctggtggagtcgtgggggaggcttgatacaggccgggggggtccctgagactctcatgtagaacctctggcttcatgtttagagtctatgacatgagttgggtccgccaggctccggggaagggctggagtgggtctcaatgatcagtgatggtggaacgaccacaaactacgccgactccgtgaagggccgtgcaccatctccagagacaattcgaaggacactttatatctgcaactcaacagactgacacccgcggacacggccgtctactactgtgtgaaagaagacggaccgcgtgggacgagggacnccgagaa

SEQ ID NO: 462590 - DNA, 503 bp, Homo sapiens; identical to SEQ ID NO: 445995
  misc_feature: HEFZJCU01CTVF2.17.25.C03.1.454.heavy.3.raw

SEQ ID NO: 462591 - DNA, 506 bp, Homo sapiens; identical to SEQ ID NO: 444696
  misc_feature: HEFZJCU01BC463.16.34.D01.1.454.heavy.3.raw

SEQ ID NO: 462592 - DNA, 534 bp, Homo sapiens
  misc_feature: HEFZJCU01DANUT.48.86.H09.1.454.heavy.3.raw
  modified_base (390)..(390): a, c, t, g, unknown or other
agtatacatacacgaccggtgctcgatttagtgctatagacttgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaactgctttgtctctggaacttctatcaagggtagcagcttctactggggctggatccgccagcccccaggaaaggggctacaatgggttggaaatgtcaattcttatgggcgctcccactacaatccggccctccagagtcgagccctcatatccatagacacgtccaacaaccagttttcccngacgctgacgtctgtgaccgccgcagacacggctgtctattattgtgcgagactaggcttctgtagtggtggtacttgcaacccgggatactactccaacttcggcttggacatcgtggggccaagggacctcggtccgtcccg

SEQ ID NO: 462593 - DNA, 537 bp, Homo sapiens; identical to SEQ ID NO: 445697
  misc_feature: HEFZJCU01ELGIE.14.57.F02.1.454.heavy.3.raw

SEQ ID NO: 462594 - DNA, 516 bp, Homo sapiens
  misc_feature: HEFZJCU01B7IDG.10.53.E09.1.454.heavy.3.raw
catagtagtgcacgaccggtgctcgatttagagagagtgtgttgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacgggctgtgtattactgttcgtttggttctgactcgtcggggaataccttcagcactggggccagggcaccctggtcaccgtctcctcagcctccaccagggcccatcggtccttcccctcggccaccctcctccaagagcacctctcgggggcacagcggccc

SEQ ID NO: 462595 - DNA, 490 bp, Homo sapiens
  misc_feature: HEFZJCU01CNP5D.4.57.F02.1.454.heavy.3.raw
agcactgtagcacgaccggtgctcgatttagctcgatatagttgggttggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggccgccctgctccagagcacctctgggggcacagcggccctggctgcctggtcaaggactacttccctacagtgct

SEQ ID NO: 462596 - DNA, 443 bp, Homo sapiens
  misc_feature: HEFZJCU01B8NC8.3.86.H09.1.454.heavy.3.raw
agacgcactccacgaccggtgctcgatttagtgctatagacttgggtttgggattcacgttgcagatgtaggtctgggtgcgacaggctcctggaaaagggcttgagtggatgggaggttttgatcctgaagagcgtgaaagaatctacgcacagaatttccagggcagagtcaacatgaccgaggacacatccacagacacatcctacatggagttgaccagcctgagatctgaagacacggccgtgtattattgtgcaacagtcgcggctagcgcagcgggccctgatgcttttgatatctggggcccagggacattggtcaccgtctcttcagcctccaccaagggcccatcggtcttccccctggcaccctcctccaagagcacctctggggcacagcggcctgggctgcctggtcaaggactacttccgagtgcgtct

SEQ ID NO: 462597 - DNA, 510 bp, Homo sapiens
  misc_feature: HEFZJCU01ET7S7.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaagggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggaccg

SEQ ID NO: 462598 - DNA, 315 bp, Homo sapiens
  misc_feature: HEFZJCU01AW4I5.7.10.A10.1.454.heavy.3.raw
cgtgtctctacacgaccggtgctcgatttagcgtcgatctccagggacgaacgccaagaggtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggccctgggctgcctggtcaaggactacttcctagagacacg

SEQ ID NO: 462599 - DNA, 524 bp, Homo sapiens; identical to SEQ ID NO: 448845
  misc_feature: HEFZJCU01D64XI.16.27.C05.1.454.heavy.3.raw

SEQ ID NO: 462600 - DNA, 501 bp, Homo sapiens; identical to SEQ ID NO: 449837
  misc_feature: HEFZJCU01BW4LU.49.80.H03.1.454.heavy.3.raw

SEQ ID NO: 462601 - DNA, 486 bp, Homo sapiens
  misc_feature: HEFZJCU01DC69J.8.33.C11.1.454.heavy.3.raw
ctcgcgtgtccacgaccggtgctcgatttagagtgagctcgttgggtttgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaaggaggggggaaccagcgggagttccaagtactcctttgacgtctggggccagggtaccctggtcaccgtctcctcagcctccaccaagggcccatcggtcttccccctggcgccctgctccaggagcacctccgagagcacagcggccctgggctgcctggtcaaggactacttccgacacgcgag

SEQ ID NO: 462602 - DNA, 522 bp, Homo sapiens
  misc_feature: HEFZJCU01DDVDX.12.40.D07.1.454.heavy.3.raw
atacgacgtacacgaccggtgctcgatttagtgatagagcgtaacaacagagggctcaccatggagtttgggctgagcgtgggtttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttccccctggcg

SEQ ID NO: 462603 - DNA, 488 bp, Homo sapiens
  misc_feature: HEFZJCU01C98YN.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaaggcccatcggtcttcccctggcgcctgctccaggagcacctccgagagcacagcgccctgggctgcctggtcaaggactacttcccacgagagta

SEQ ID NO: 462604 - DNA, 505 bp, Homo sapiens
  misc_feature: HEFZJCU01AN29C.14.71.G05.1.454.heavy.3.raw
cgtctagtaccacgaccggtgctcgatttagtgtcgtcgcaagagagaggagcccagccctgggattttcaggtgttttcattcggtgatcaggactgaacagagagaactcaccatggagtttgggctgagctggcttttcttgtggctattttaaaaggtgtgcagtgtgaggtgcagctgttggagtctgggggaggcttggtacagcctggggggtccctgagactctcctgtgcagcctctggattcgtctttagcagctatgccatgagctgggctcgccaggctccagggaaggggctggagtgggtctctgctattcctggcagtggtgatatcgaatactacgcagactccgtgaagggccggttcactgtttccagagacaattccaagaacacactgtatctgcagatgacagcctgagagccgaggacacggccgtatattactgtgcgaaacgccaagtatttttggagtggttattatacctttgacttcg

SEQ ID NO: 462605 - DNA, 514 bp, Homo sapiens
  misc_feature: HEFZJCU01D61PO.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacgggccgtctattattgtgtgagagtttatggcgatggctggtggacagatcactggggccac

SEQ ID NO: 462606 - DNA, 533 bp, Homo sapiens
  misc_feature: HEFZJCU01CK166.17.28.C06.1.454.heavy.3.raw
cgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaagtaatggctgtgtttattggggccagggacgccctggtcaccggt

SEQ ID NO: 462607 - DNA, 523 bp, Homo sapiens
  misc_feature: HEFZJCU01AEWPA.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcgagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtcttcccctggcgccctgctccaggagcaccctccgagagcacacgcggccc

SEQ ID NO: 462608 - DNA, 499 bp, Homo sapiens
  misc_feature: HEFZJCU01BB7XS.13.15.B04.1.454.heavy.3.raw
tcacgtactacacgaccggtgctcgatttagacagtatatatccgcgggggccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgtgtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagagtacactattaaattactatgatagtagtgg

SEQ ID NO: 462609 - DNA, 495 bp, Homo sapiens
  misc_feature: HEFZJCU01EH23A.51.64.F09.1.454.heavy.3.raw
cgatcgtatacacgaccggtgctcgatttagcgcgtatacaaggggctgggagaggagcccagcactagaagtcggcggtgtttccattcggtgatcagcactgaacacagaggactcaccatggagtttgggctgagctgggttttcctcgtcgttcttataagaggtgtccagtctgaggcgcagctggtggagtctgggggaggagtggtccagcctgggaggtccttgagactctcctgtgcagcctctggattcaccttcagagtctatggcatgaactgggtccgccaggctccaggcaaggggctggagtgggtggcattcatttcagaggatggaattaagagatactatacagactccgtgaagggccgattcaccatctccagagacaattccaagaactcgctctatctgcaaatgagcagcctgagacctgaggacacggctgtctattactgtgcgaaacggatgagtgggaactagggttt

SEQ ID NO: 462610 - DNA, 515 bp, Homo sapiens
  misc_feature: HEFZJCU01DZF15.12.33.C11.1.454.heavy.3.raw
atacgacgtacacgaccggtgctcgatttagagtgagctcgttgggtttgggagaggagccccagccctgagattcccacgtgtttccatccagtgatcagcactgaacacagaggactcgccatggagtctgggctgaactgggttttccttgttgctattttaaaaggtgtccactgtgaggtgcaactggtggagtcggggggaggtgtagtacggccgggggggtccctgagactctcatgtgcagggtctggattcaactttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgttgcgagagccctcggcagaagtctggactactactatatggtatgg

SEQ ID NO: 462611 - DNA, 500 bp, Homo sapiens
  misc_feature: HEFZJCU01AQCTZ.48.41.D08.1.454.heavy.3.raw
agtatacatacacgaccggtgctcgatttagtcacgcgagaaagggaaaggggctctgggagacgagcccagcactggaagtcgccggtgtttccattcggtgatcagcactgaacacagaggactcaccatggagtttgggctgacctgggttttcctcgttgctcttttaagaggtgtccagtgtcaggtgcagctggtggagtctgggggaggcgtggtccagcctgggaggtccctgagactctcttgtgcagcctctggattcattttcagtgactatggtatgcactgggtccgccaggctccaggcaaggggctggagtgggtggcagtcataccttctgctggaaggaatatctactacgcgggctccgtgaagggccgattcaccatctccagagacaattccaacaagacactgtatctgcaaatgaacagcctgagggctgaagacacggctgtgtattactgtgcgagaggctatcactatgggttac

SEQ ID NO: 462612 - DNA, 477 bp, Homo sapiens; identical to SEQ ID NO: 451758
  misc_feature: HEFZJCU01EBYZI.16.71.G05.1.454.heavy.3.raw

SEQ ID NO: 462613 - DNA, 510 bp, Homo sapiens
  misc_feature: HEFZJCU01D74Q5.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaatttttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggtgaactactggggccagggcaccctggtcaccgtctcctcagcttccaccaagggcccatcggtcttcccctggcgccctgctccaggagcacctctgggggcacagcggccctggctgcctggtcaaggactactcccatac

SEQ ID NO: 462614 - DNA, 506 bp, Homo sapiens
  misc_feature: HEFZJCU01B1Y77.2.33.C11.1.454.heavy.3.raw
acgctcgacacacgaccggtgctcgatttagagtgagctcgttgggtttgggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaagggctggagtgggttggccatataaaagtaagactgctggtgagacaacagactacgctgctgccttcagaggcagattcaccatcttcagagatgaatcacagagcactctgtttctgcaatgaacagcctggaagacgcggacacagccatgtattattgtacattaggacactatagtccctggggccagggaaccctcg

SEQ ID NO: 462615 - DNA, 372 bp, Homo sapiens; identical to SEQ ID NO: 444513
  misc_feature: HEFZJCU01CRVIA.5.23.C01.1.454.heavy.3.raw

SEQ ID NO: 462616 - DNA, 524 bp, Homo sapiens
  misc_feature: HEFZJCU01DJPU5.12.71.G05.1.454.heavy.3.raw
  modified_base (466)..(466): a, c, t, g, unknown or other
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcacccattaccgcggacgaggccacgaagacagtctacatggaattgagcagcctgagatttgacgacacggccatgtattaactgtgcgaggagggccagctgctgggagcgtctacatatttcgacccctgggccagggaacccaggtcaccgtctcctcagcctccaccaagggcccatccgtcttcccctggcgccctgctccaggngcacctccgacgagcacagcggccctgggctgcctcggtcaaggactacttcctaccg

SEQ ID NO: 462617 - DNA, 507 bp, Homo sapiens
  misc_feature: HEFZJCU01C7DQ6.48.59.F04.1.454.heavy.3.raw
agtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgtcctttgatatgtcggggccgaagggacaatggtcaccgt

SEQ ID NO: 462618 - DNA, 506 bp, Homo sapiens
  misc_feature: HEFZJCU01EL7JY.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtaggaagagacgttggtggcgtaccggcggggctggaccacgtcggggacc

SEQ ID NO: 462619 - DNA, 491 bp, Homo sapiens
  misc_feature: HEFZJCU01DW4B5.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaacgggccatcggtcttcccctggcacctcctccaagagcacctctgggggcacagcggccctgggctgcctggtcaaggactaccttccgagtgcgtct

SEQ ID NO: 462620 - DNA, 390 bp, Homo sapiens; identical to SEQ ID NO: 448683
  misc_feature: HEFZJCU01CTKNL.11.25.C03.1.454.heavy.3.raw

SEQ ID NO: 462621 - DNA, 536 bp, Homo sapiens
  misc_feature: HEFZJCU01CE11P.52.9.A09.1.454.heavy.3.raw
cgcagtacgacacgaccggtgctcgatttagcgagacgcgcagggggctttccgagagtcatggacctcctgcacaagaacatgaaacacctgtggttcttcctcctcctggtggcagctcccagatgggtcctgtcccaggtgcacctacaacagtggggcgcaggactgttgaagccttcggagaccctgtccctcacctgcgctgtcgatggtgggtccttcagtggtcgctactggacctggatccgccagcccccagggaaggggctggagtggattggggaaatcaatcatactggaagcattaactataacccgtcccttaagagtcgagtcaccatatcagtcgacacgtccaagaaccaattctccctgaaggtgaggtctgttaccgccgcggacacggctgtctattactgtgcgaaaggccctcacgatgaaaactacgcccctggcgctatggacgtctggggccaagggaccacggtcaccgtctcctcagcctccaccaacgggcccatcggtcttcccct

SEQ ID NO: 462622 - DNA, 520 bp, Homo sapiens
  misc_feature: HEFZJCU01CIQ6W.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgtctggggccaggggaccctggtcatcgtctccccagcctccaccaaggcccatcggtcttcccctggccg

SEQ ID NO: 462623 - DNA, 389 bp, Homo sapiens
  misc_feature: HEFZJCU01EB0E6.13.42.D09.1.454.heavy.3.raw
tcacgtactacacgaccggtgctcgatttagacacatacgcagggaaaggggctggagtggattggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgtgagagatcgagatgtgtcatcgcggggcacttttgatatctggggccaagggtcgatggtcatcgtctcttcagcctccaccaagggcccatcggtcttccccctggcgccctgctccaggagcacctccgagagcacagcggccctgggctgcctggtcaggactacttcctagtacgtga

SEQ ID NO: 462624 - DNA, 513 bp, Homo sapiens
  misc_feature: HEFZJCU01B6PXR.7.71.G05.1.454.heavy.3.raw
cgtgtctctacacgaccggtgctcgatttagtgtcgtcgcaagagagagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaacaggcgggagttccaagtactcctttg

SEQ ID NO: 462625 - DNA, 519 bp, Homo sapiens; identical to SEQ ID NO: 446228
  misc_feature: HEFZJCU01C0S49.9.43.D10.1.454.heavy.3.raw

SEQ ID NO: 462626 - DNA, 512 bp, Homo sapiens
  misc_feature: HEFZJCU01EYS8L.16.86.H09.1.454.heavy.3.raw
tgtactactccacgaccggtgctcgatttagtgctatagactgggtttggggactttctgagagtcctggacctcctgtgcaagaacatgaaacacccgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccactaggtttgactctggggccagggaacctgtcgcctcgtcctc

SEQ ID NO: 462627 - DNA, 522 bp, Homo sapiens
  misc_feature: HEFZJCU01C6BF7.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcactttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctggggccggggaaccctggtcaccgtctccccacctccaccaaggcccatcggtcttcccctggcaccctcctccaagagcacctctgggggcacagcggccctggctgcctggtcaaggactacttccatactcgta

SEQ ID NO: 462628 - DNA, 490 bp, Homo sapiens
  misc_feature: HEFZJCU01AW75O.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagttttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttatactgtgggagaaatccta

SEQ ID NO: 462629 - DNA, 419 bp, Homo sapiens; identical to SEQ ID NO: 445646
  misc_feature: HEFZJCU01EJPCP.11.37.D04.1.454.heavy.3.raw

SEQ ID NO: 462630 - DNA, 499 bp, Homo sapiens
  misc_feature: HEFZJCU01C18N9.13.33.C11.1.454.heavy.3.raw
tcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgtacagaactttcaggacagggtcaccatgaccacggacacgtccatcaacacagcctacatggaactgaggagcctaagatctgacgacacggccgtttattattgtgcaataagaattgcaaacgatgcttttgatatgtgggccaa

SEQ ID NO: 462631 - DNA, 389 bp, Homo sapiens
  misc_feature: HEFZJCU01D4DJO.16.17.B06.1.454.heavy.3.raw
tgtactactccacgaccggtgctcgatttagtcgatagtgaagggactggagtggattgcctatatctcttacagtgggagcagcaactacaacccctccctcaagagtcgagtcgacatattagtagacacgtccaagaaccagttttccctgaggctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggccctgggctgcctggtcaaggactattccgagtagtaca

SEQ ID NO: 462632 - DNA, 526 bp, Homo sapiens
  misc_feature: HEFZJCU01DWYH2.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctgggccagggaacccaggtcaccgtctcctcagcctccaccaagggcccatccgtcttcccctcgcgccctcgctccaggagcacctccgacgagcaccagcggccctcgggctgcctggtcaaggactacttccttaccg

SEQ ID NO: 462633 - DNA, 482 bp, Homo sapiens; identical to SEQ ID NO: 446046
  misc_feature: HEFZJCU01AEBWX.10.35.D02.1.454.heavy.3.raw

SEQ ID NO: 462634 - DNA, 517 bp, Homo sapiens
  misc_feature: HEFZJCU01DXGV4.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaacccgtggtcgccgtctcctcagcctccaccaagggcccatcggtcttccccctggccaccctcctccaagagcacctctgggggcacagcggccctggctgcctgtcaaggactactccagacgtatca

SEQ ID NO: 462635 - DNA, 406 bp, Homo sapiens; identical to SEQ ID NO: 448346
  misc_feature: HEFZJCU01CBWFT.53.77.G11.1.454.heavy.3.raw

SEQ ID NO: 462636 - DNA, 517 bp, Homo sapiens
  misc_feature: HEFZJCU01E05JG.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagttttggctgagcgtgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttattatagtagtggtagtacatactccgcagactccgtgaggggccattcaccatctccagagacaattccaagaacacgctgtttcttcaaatgaacagcctgagagccgatgacacggccgtgtattactgtgcgagagagtcggggcccacggaacgttactacgctatggacgtcgtcggggacc

SEQ ID NO: 462637 - DNA, 400 bp, Homo sapiens
  misc_feature: HEFZJCU01CX5O9.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctgggcaaagggaccgcggtcaccgtctcctcagcctccaccaagggcccatcggtcttccccctggcgccctgctccaggagcacctccgagagcacagcggccctgggctgcctggtcaaggactacttcctacgtcgagct

SEQ ID NO: 462638 - DNA, 437 bp, Homo sapiens
  misc_feature: HEFZJCU01A7JHA.3.21.B10.1.454.heavy.3.raw
agacgcactccacgaccggtgctcgatttagtgtcgtcgcaaggggccagtatctctacttacgagactgcttggaattggttcaggctgtccccttcgagaggccttgagtggctgggaaggacgtttatacaagtccaagtgggaacatcattatgcagaatctgtgaaaagtcgagtaatcatcaacgccgacacatccaggaaccagttctccctgcaactgaagtctgtgactcccgaggacacggctgtttattactgtgcaagagcgaggaggagcagttttgacagctggggccagggaaccctggtcaccgtctcctcagcctccaccaagggcccatcggtcttcccctggcgccctgctccaggagcacctccgagagcacagcggccctgggctgcctggtcaaggactacttccgagtgcgtct

SEQ ID NO: 462639 - DNA, 498 bp, Homo sapiens
  misc_feature: HEFZJCU01ANZ8O.48.34.D01.1.454.heavy.3.raw
agtatacatacacgaccggtgctcgatttagatcgtctgtgttgggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggccgcctgctccaggagcacctccgagagcacagcggccctgggctgcctggtcaaggactacttcctatgtatact

SEQ ID NO: 462640 - DNA, 497 bp, Homo sapiens
  misc_feature: HEFZJCU01CA62R.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctgggaatggggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatcctagtggc

SEQ ID NO: 462641 - DNA, 392 bp, Homo sapiens; identical to SEQ ID NO: 444682
  misc_feature: HEFZJCU01EZAV2.16.70.G04.1.454.heavy.3.raw

SEQ ID NO: 462642 - DNA, 396 bp, Homo sapiens; identical to SEQ ID NO: 444469
  misc_feature: HEFZJCU01CZ47U.47.46.E02.1.454.heavy.3.raw

SEQ ID NO: 462643 - DNA, 530 bp, Homo sapiens
  misc_feature: HEFZJCU01BP036.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcgcgtatctgcagatcaccagccttcaggctgaggacactgccatttattactgtgcgagagagggggagagtggagtagaacgtaaatacgggaaaccgtttgacttttgggccagggaaccctggtcaccgtctcctcagcctccaccaaggcccatcggtcttccgcctggcacctcctccagagcacctctgggggtcacagcggccctcgggctgcccg

SEQ ID NO: 462644 - DNA, 503 bp, Homo sapiens; identical to SEQ ID NO: 458643
  misc_feature: HEFZJCU01ENV9M.4.58.F03.1.454.heavy.3.raw

SEQ ID NO: 462645 - DNA, 502 bp, Homo sapiens
  misc_feature: HEFZJCU01EI84U.13.87.H10.1.454.heavy.3.raw
tcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgcaaaagataccaaccccttacgt

SEQ ID NO: 462646 - DNA, 512 bp, Homo sapiens
  misc_feature: HEFZJCU01DM47P.13.87.H10.1.454.heavy.3.raw
tcacgtactacacgaccggtgctcgatttagcagtactgcgttgggtttgggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaaggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgcaaagatccaaccccttacgtactttttggagtggttacg

SEQ ID NO: 462647 - DNA, 476 bp, Homo sapiens
  misc_feature: HEFZJCU01AOC76.12.5.A05.1.454.heavy.3.raw
atacgacgtacacgaccggtgctcgatttagatagatagacagggagaggctcttctgtgtgtagtggttgtgcagagcctcatgcatcacggagcatgagaagacgttcccctgctgccacctgctcttgtccacggtgagcttgctgtagaggaagaaggagccgtcggagtccagcatgggaggcgtggtccaacctggaaagtccctgagcctctcctgtgcagcctctggattcacattcagtacccgtgctatgcagtgggtgcgccaggctccaggcaaggggctggactgggtggccgttatagcacctgatggcaatgtgaagtattatgcagactccgtgaggggccgattcacgatcttaagagacaattcgaagaacactctgtatctacagatggacagcctgagagttgaagacacggctctttattactgtgcgagagagaattacgatttgactctcggt

SEQ ID NO: 462648 - DNA, 516 bp, Homo sapiens; identical to SEQ ID NO: 445754
  misc_feature: HEFZJCU01DT34N.48.19.B08.1.454.heavy.3.raw

SEQ ID NO: 462649 - DNA, 521 bp, Homo sapiens
  misc_feature: HEFZJCU01DP0Q2.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctgggagtggggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggttctacttcgatctctc

SEQ ID NO: 462650 - DNA, 495 bp, Homo sapiens; identical to SEQ ID NO: 445359
  misc_feature: HEFZJCU01EAHDL.4.21.B10.1.454.heavy.3.raw

SEQ ID NO: 462651 - DNA, 500 bp, Homo sapiens; identical to SEQ ID NO: 445720
  misc_feature: HEFZJCU01DWZA7.3.20.B09.1.454.heavy.3.raw

SEQ ID NO: 462652 - DNA, 516 bp, Homo sapiens
  misc_feature: HEFZJCU01B9878.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaaatctgagagtcgacgacacggccacctattattgtgcgcgacatgactacgctcaattctggggccagggagccaggtcaccgtctcccacgcctccaccaagggcccatcggtcttcccctcggcgccctgctccaggagcacctccgacgacgcacagcggccctggggcctgcctcggtcaagggactactttccccactacttac

SEQ ID NO: 462653 - DNA, 519 bp, Homo sapiens
  misc_feature: HEFZJCU01CI19C.48.26.C04.1.454.heavy.3.raw
agtatacatacacgaccggtgctcgatttagtctagcgactttgggtttggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatcccacgagcacagcctacatggagctgaggagcctgagatcgtagacgacacggccgtgtattactgtgcgagagaaggggtttttacagttggttcggggagtctccgacccagccaatggttcgaccccg

SEQ ID NO: 462654 - DNA, 503 bp, Homo sapiens; identical to SEQ ID NO: 459423
  misc_feature: HEFZJCU01BZ75A.15.55.E11.1.454.heavy.3.raw

SEQ ID NO: 462655 - DNA, 498 bp, Homo sapiens
  misc_feature: HEFZJCU01DDXRE.15.55.E11.1.454.heavy.3.raw
tctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtgttagtggtgaaaacacatattacgcaggctccgtgaagggccgcttcaccatctccagagacaattccaacaacacactttatcttcaaatgaacagcctgcgagccgaggacacggccgtatactactgtgcgagagatcgaacaggcccgtgggagcccgttgactactggggccagggaaccctggtcaccgtctcctcacctccaccaaggccatcggtcttcccctggcaccctcctccaagagcacctctgggggcacagcggccctgggctgcctggtcaggactacttccgctacgtga

SEQ ID NO: 462656 - DNA, 389 bp, Homo sapiens
  misc_feature: HEFZJCU01EVTCL.11.27.C05.1.454.heavy.3.raw
cgagagataccacgaccggtgctcgatttagacgcgatcgaaggggctggagtagggtctcatccattagtagtaatagtgcctacagatactacgcagactcactgaagggccgactcaccatctccagagacaacgccaagaactcactgtatctgcaaatgaacagcctgagagccgaggacacggctggtgtattactgtgcgagaggagctattatctggaaccccgatgcttttgatttctggggccaagggacaatgctcaccgtctcttcagcctccaccaagggcccatcggtcttccccctggcaccctcctccaagagcacctctgggggcacagcggccctgggctgcctggtcaaggactacttccgtatctctcg

SEQ ID NO: 462657 - DNA, 515 bp, Homo sapiens
  misc_feature: HEFZJCU01ANIDC.7.78.H01.1.454.heavy.3.raw
  modified_base (469)..(469): a, c, t, g, unknown or other
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtgaattgactactggggccagggaaccctggtcaccgtctcctcagcctccaccaagggcccatcggtcttcccctggcaccctcctccaagagcactctggggcncagcggccctgggctgcctggtcaaggactacttcctagagacacg

SEQ ID NO: 462658 - DNA, 524 bp, Homo sapiens
  misc_feature: HEFZJCU01EEO9J.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctgggccggggaaccctggtcaccgtctcccaccctccaccaaggcccatcggtcttccccctggcaccctcctccaagagcacctctgggggcacagcggccctgggctgcctggtcaaggactacttcccatactcgta

SEQ ID NO: 462659 - DNA, 499 bp, Homo sapiens
  misc_feature: HEFZJCU01EWIMR.49.80.H03.1.454.heavy.3.raw
agtcgagagacacgaccggtgctcgatttagctgtgcgtcgaaggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttcccctggcaccctcctccaagagcacctctgggggcacagcggccctgggctgcctggtcaaggactactcctct

SEQ ID NO: 462660 - DNA, 535 bp, Homo sapiens
  misc_feature: HEFZJCU01DZ7WT.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggccc

SEQ ID NO: 462661 - DNA, 505 bp, Homo sapiens; identical to SEQ ID NO: 450152
  misc_feature: HEFZJCU01AE4Z1.51.71.G05.1.454.heavy.3.raw

SEQ ID NO: 462662 - DNA, 483 bp, Homo sapiens
  misc_feature: HEFZJCU01D0I8Z.48.67.G01.1.454.heavy.3.raw
agtatacatacacgaccggtgctcgatttagagtatacatattgggtttggggatcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttatggtggataaagccacgagcacagtctacatgcagctgagcagcctgagacacaacgacacggccgtctattattgttccagagataatcgcgtgaataaagat

SEQ ID NO: 462663 - DNA, 515 bp, Homo sapiens
  misc_feature: HEFZJCU01CE1UO.8.34.D01.1.454.heavy.3.raw
ctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgttcatctgagggcagtgttcaatggtatgcagactccgtgaagggccgattcaccatctccagagacaattccaggaacacaatgtatttggagctgaacagacctaagtcctgaggacacgggcgtatactactgtacgaagggaggggggaaccgaggcggggagttaccaagtactcctttg

SEQ ID NO: 462664 - DNA, 538 bp, Homo sapiens
  misc_feature: HEFZJCU01COX6J.48.67.G01.1.454.heavy.3.raw
agtatacatacacgaccggtgctcgatttagagtatacatattgggtttggggggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaactgctttgtctctggaacttctatcaagggtagcagcttctactggggctggatccgccagcccccaggaaggggctacaatgggttggaaatgtcaattcttatgggcgctcccactacaatccggccctccagagtcgagccctcatatccatagacacgtccaacaaccagttttccctgacgctgacgtctgtgaccgccgcagacacggctgtctattattgtgcgagactaggcttctgtagtggtggtacttgcaacccgggatactactccaacttcggcttggacatcgtggggccgaagggacctcggtcgccgtttcctcagcctccaccaacggg

SEQ ID NO: 462665 - DNA, 489 bp, Homo sapiens
  misc_feature: HEFZJCU01C8T1E.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggccggttctccatctccagagacaattccaagaacacgctgtatctgcaattgaacagcctgagagccgaggacacggccgtatattactgtgcgaaagatttggggaatgacca

SEQ ID NO: 462666 - DNA, 520 bp, Homo sapiens; identical to SEQ ID NO: 455235
  misc_feature: HEFZJCU01BNG24.13.76.G10.1.454.heavy.3.raw

SEQ ID NO: 462667 - DNA, 491 bp, Homo sapiens
  misc_feature: HEFZJCU01CY3S3.11.38.D05.1.454.heavy.3.raw
cgagagataccacgaccggtgctcgatttagtatctgatagttgggtttgggggaggcttggtacagcctggggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagtggtggtagctgctactggggccagggaaccctggtcaccgtctcctcagcctccaccaagggcccatcggtcttccccctggcaccctcctccaagagcacctctgggggcacagcggccctgggctgcctgtcaaggactacttccgtatctctcg

SEQ ID NO: 462668 - DNA, 514 bp, Homo sapiens
  misc_feature: HEFZJCU01C1NQX.3.71.G05.1.454.heavy.3.raw
agacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggattttccttttggctattttaaaaggtgtccggtgtgaagtgcaactggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtgataacatcggctatgcggactctgtgaagggccgattcaccatctccagagacaacgccaagaactccctgtatctgcaaatgaacagtctgagacctgaggacacggcccttgtatttactgtgtaaagtcccgggggaaatatagtacgaattttt

SEQ ID NO: 462669 - DNA, 520 bp, Homo sapiens
  misc_feature: HEFZJCU01EM0LY.12.58.F03.1.454.heavy.3.raw
atacgacgtacacgaccggtgctcgatttagtctgatcgagaagggaaaggggcagagaggagccttagccctggactccaaggcctttccacttggtgatcagcactgagcacagaggactcaccatggaattggggctgagctgggttttccttgttgctattttagaaggtgtccagtgtgagggacaattggtggagtctgggggaggcttggtccagccggggggtccctgagactctcctgtacagcctctggattcactctcggaaacttttggatggtctgggtccgccaggctccagggaaggggctggagagggtggccaatatacagtcaggtggaggtacgatacactatctcgactctgtgaagggccggttcaccatctccagagacaacgccaagaattcactgtatctgcaaatgaacagcctgagagtcgaagacaacgggtatttattattgtgtgcgagatctggatttccttcgaaatgaagtgtggttcgatgtgtttg

SEQ ID NO: 462670 - DNA, 503 bp, Homo sapiens
  misc_feature: HEFZJCU01DHBO7.51.81.H04.1.454.heavy.3.raw
cgatcgtatacacgaccggtgctcgatttagtagtgtagattcgcgggggctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctacg

SEQ ID NO: 462671 - DNA, 484 bp, Homo sapiens
  misc_feature: HEFZJCU01CKP68.49.27.C05.1.454.heavy.3.raw
  modified_base (451)..(451): a, c, t, g, unknown or other
agtcgagagacacgaccggtgctcgatttagacgcgatcgaagggtttggggagctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgaganctgaagacacggctgtatattactgtgcgtaaa

SEQ ID NO: 462672 - DNA, 492 bp, Homo sapiens
  misc_feature: HEFZJCU01C1C4W.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatatgta

SEQ ID NO: 462673 - DNA, 501 bp, Homo sapiens; identical to SEQ ID NO: 445027
  misc_feature: HEFZJCU01A70RP.26.23.C01.1.454.heavy.3.raw

SEQ ID NO: 462674 - DNA, 506 bp, Homo sapiens
  misc_feature: HEFZJCU01DUQ67.13.33.C11.1.454.heavy.3.raw
tcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaataagaaattgacaaacgatgcttttgatatgtggggccaagggactacg

SEQ ID NO: 462675 - DNA, 477 bp, Homo sapiens
  misc_feature: HEFZJCU01B3QBO.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctcgtggggcacagcggccctgggctgcctggtcaaggactacttccgagtagtaca

SEQ ID NO: 462676 - DNA, 312 bp, Homo sapiens; identical to SEQ ID NO: 444415
  misc_feature: HEFZJCU01ACYHA.7.10.A10.1.454.heavy.3.raw

SEQ ID NO: 462677 - DNA, 511 bp, Homo sapiens
  misc_feature: HEFZJCU01EF8FS.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatcggtcttcccccgtggccgccctgcctccaggacg

SEQ ID NO: 462678 - DNA, 520 bp, Homo sapiens
  misc_feature: HEFZJCU01CVDGW.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttccccctggcaccctcctccaagagtacctctgggggcacagcggccctgggctgcctggtcaaggactacttcctagagacacg

SEQ ID NO: 462679 - DNA, 505 bp, Homo sapiens
  misc_feature: HEFZJCU01D6WPI.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcaggcggcctttgactttctc

SEQ ID NO: 462680 - DNA, 521 bp, Homo sapiens
  misc_feature: HEFZJCU01C9FKN.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggacggtttttggggcgcggactcctcttgagatcgtggggccaggggacaagtggtcaccgtctcttc

SEQ ID NO: 462681 - DNA, 514 bp, Homo sapiens
  misc_feature: HEFZJCU01CQ637.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttcaccaagggcccatcggtcttcccctggcgccctgctccaggagcacctctgggggcacagcggcccg

SEQ ID NO: 462682 - DNA, 520 bp, Homo sapiens
  misc_feature: HEFZJCU01B81T8.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcatcctctgggttcaccgtcagtcacacctacatgagctgggtccgccaggctccagggaaggggctggagtgcgtctcttttatttatagtagtggtagtacatactccgcagactccgtgaggggccgattccaccatctccagagacaattccaagaacacgctgtttcttcaaatgaacagcctgagagccgatgacacggccgtgtattactgtgcgagagatggggcccacgaacgttactacgctatggacgtctggggccaagggaccg

SEQ ID NO: 462683 - DNA, 490 bp, Homo sapiens
  misc_feature: HEFZJCU01BHEA4.11.13.B02.1.454.heavy.3.raw
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctgtcaaggactacttccgtatctctcg

SEQ ID NO: 462684 - DNA, 525 bp, Homo sapiens
  misc_feature: HEFZJCU01BAOY8.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccactaggtttgactactgggggccaggggaagcttggtcaccgtctcctcagcctccc

SEQ ID NO: 462685 - DNA, 483 bp, Homo sapiens; identical to SEQ ID NO: 444639
  misc_feature: HEFZJCU01ASZJG.11.23.C01.1.454.heavy.3.raw

SEQ ID NO: 462686 - DNA, 539 bp, Homo sapiens
  misc_feature: HEFZJCU01BLGNX.48.40.D07.1.454.heavy.3.raw
agtatacatacacgaccggtgctcgatttagtgatagagcgtaacaacagaggggcccagacctgggattcccagctgtttctgcttgctgatcaggaccgcacacagagagctcaccatggagttggggctgacctgggttttccttgtggctactttaagaggtgtcctgtgtgaggtgcacctgctggagtccgggggaggcttagttcggccgggggagtccctgagactcgcctgtgtagtgtctggattcaccttcaggaattacgacatggactgggtccgccaagctccagggaaggggctggagtgggtctcaaacgtgaacgttgatggcgggatcacaaatacgcggactccgtgaaaggccgcttcaccgtctccagagacaacggcgagaatactctgtatttgcagatgagaaatctgagaggcgaggacaccgcgctttattattgtacaacgtcgttttacttttctaatggtggctcttacgaacgacatgactattggggtcggggaaccctggtctaccg

SEQ ID NO: 462687 - DNA, 528 bp, Homo sapiens; identical to SEQ ID NO: 450273
  misc_feature: HEFZJCU01BE03A.4.59.F04.1.454.heavy.3.raw

SEQ ID NO: 462688 - DNA, 510 bp, Homo sapiens
  misc_feature: HEFZJCU01DZUUH.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaagggaggggggaaccgagcgggagtccaagtactcttt

SEQ ID NO: 462689 - DNA, 509 bp, Homo sapiens
  misc_feature: HEFZJCU01AZFO9.52.35.D02.1.454.heavy.3.raw
cgcagtacgacacgaccggtgctcgatttagcacacgatagttgggtttgggaccggtgctcgattcagtgtgaggcgcagctggtggagtctgggggaggcttggtccagcctggggggtccctgacactctcctgtgtagcctctggattcaccttttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggccgtggcacctggtcactgtcttctcagcctccaccaagggcccatcggtcttcccctggcaccctcctccaagagcacc

SEQ ID NO: 462690 - DNA, 507 bp, Homo sapiens; identical to SEQ ID NO: 446637
  misc_feature: HEFZJCU01DZMTO.16.34.D01.1.454.heavy.3.raw

SEQ ID NO: 462691 - DNA, 481 bp, Homo sapiens; identical to SEQ ID NO: 448685
  misc_feature: HEFZJCU01C0KUB.7.10.A10.1.454.heavy.3.raw

SEQ ID NO: 462692 - DNA, 483 bp, Homo sapiens; identical to SEQ ID NO: 453752
  misc_feature: HEFZJCU01CE58I.19.53.E09.1.454.heavy.3.raw

SEQ ID NO: 462693 - DNA, 505 bp, Homo sapiens
  misc_feature: HEFZJCU01BXBWQ.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggcacctattattgtgcgcgacatgactacgctcaattctggggccagggacg

SEQ ID NO: 462694 - DNA, 506 bp, Homo sapiens
  misc_feature: HEFZJCU01CW00A.22.86.H09.1.454.heavy.3.raw
  modified_base (496)..(496): a, c, t, g, unknown or other
acatacgcgtcacgaccggtgctcgatttagtgctatagacttgggtttgggctgagcgtggttttcgtcgttaggctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggcactggtcaccgtctcttcagcctccaccaagggcccatcggtcctttcccctggccncccgtgctcc

SEQ ID NO: 462695 - DNA, 497 bp, Homo sapiens; identical to SEQ ID NO: 447711
  misc_feature: HEFZJCU01CIERM.16.37.D04.1.454.heavy.3.raw

SEQ ID NO: 462696 - DNA, 519 bp, Homo sapiens
  misc_feature: HEFZJCU01AEILK.49.34.D01.1.454.heavy.3.raw
agtcgagagacacgaccggtgctcgatttagatcgtctgtgttgggtttggggggaagaggaagactgacggtcctcccaggagttcaggtgctgggcaccgtgggcctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctactactgtgcgactgagatgtcttattacgatgccagtgctttagtaccgttcgacccctggggccgagggagccctggtcaccgtctcctcagcttccaccaagggcccatcggtcttcccctcggcgccctgctccaggagcacctcgg

SEQ ID NO: 462697 - DNA, 497 bp, Homo sapiens
  misc_feature: HEFZJCU01DUORZ.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaaccaggtggtccttacaatgaccaacatggaccctgtggacacagtcacatattactgtgcacagagatacgggcagcacgtggtttggggctacgtggggccagggaaccctggtcaccgtctcctcagcctccaccg

SEQ ID NO: 462698 - DNA, 484 bp, Homo sapiens
  misc_feature: HEFZJCU01EB17R.47.59.F04.1.454.heavy.3.raw
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcgaaaccaaatttttcactactggggccagggatccctggtcgccgtcggctcagcctccaccaagggcccatcggtcttccccctggcgccctgctccaggagcacctccgagagcacagcggccctgggctgcctggtcaaggactacttcctacgtgagct

SEQ ID NO: 462699 - DNA, 511 bp, Homo sapiens
  misc_feature: HEFZJCU01EWH2G.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtccttccccctggccgccctgctccaggagcacctccgagagcacagcggccctcgggctcgcctggtcaaggactaccttcccactacta

SEQ ID NO: 462700 - DNA, 512 bp, Homo sapiens
  misc_feature: HEFZJCU01AHINI.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctggtgacagatcactggggccac

SEQ ID NO: 462701 - DNA, 482 bp, Homo sapiens; identical to SEQ ID NO: 461665
  misc_feature: HEFZJCU01D25BA.19.53.E09.1.454.heavy.3.raw

SEQ ID NO: 462702 - DNA, 512 bp, Homo sapiens
  misc_feature: HEFZJCU01DCDY9.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacaatcaacatggagttgcggagcctgcgatctgacgcgcggccgtatattactgtgcgagagtacgtagcggctcgtcctttgactactggggcctgggaactctggtcaccgtct

SEQ ID NO: 462703 - DNA, 506 bp, Homo sapiens; identical to SEQ ID NO: 454268
  misc_feature: HEFZJCU01DAWU7.10.38.D05.1.454.heavy.3.raw

SEQ ID NO: 462704 - DNA, 532 bp, Homo sapiens
  misc_feature: HEFZJCU01CBGMX.48.12.B01.1.454.heavy.3.raw
agtatacatacacgaccggtgctcgatttagtagtgtagattccgcgggggctttctgagagtcatggatctcatgtgcaagaaaatgaagcacctgtggttcttcctcctgctggtggcgtctcccagatgggtcctgtcccagctgcacctgcaggagtcgggcccaggactggtgaggccttcggagaccctgtccctcacctgcactgtctctggtgactccatcaacagtggtactttttactactggggctggatccgccagaccccagggaagggtctggagtggattgggagtgtctattctagtgggaacacccactacaatccgtccctcaagagtcgagtcaccatatccgtggacacgtccaagaacgagttctccctgaggttacaatctgtgaccgccgcagacacggctgtatattactgtgcgagacaccgggagggggcttactatggatcggggcgggagttactactttgactacgtggggccgaggggagtcctggtcaccgtctcctcacg

SEQ ID NO: 462705 - DNA, 538 bp, Homo sapiens
  misc_feature: HEFZJCU01ELEZB.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttacaaatgaataacctgagagccgaggacacggccatgtattactgtgtggggcatttacttcgaccctgggggacccgggaaccctgggtccaccggtcctcccccaccctccaaccg

SEQ ID NO: 462706 - DNA, 379 bp, Homo sapiens; identical to SEQ ID NO: 444450
  misc_feature: HEFZJCU01DT6U5.47.77.G11.1.454.heavy.3.raw

SEQ ID NO: 462707 - DNA, 510 bp, Homo sapiens
  misc_feature: HEFZJCU01EC3GI.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctggggccagggaaccctggtcaccgtctcctcagcctccaccaaggccatcggtcttcccctcggcaccctcctccaagagcacctctgggggcacagcggccctgggctgcctggtcaaggactactccgtactacg

SEQ ID NO: 462708 - DNA, 554 bp, Homo sapiens
  misc_feature: HEFZJCU01A5T7R.49.73.G07.1.454.heavy.3.raw
agtcgagagacacgaccggtgctcgatttagctctacgctcaggggctgggagacgagcccagcactggaagtcgccggtgtttccattcggtgatcatcactgaacacagaggactcaccatggagtttgggctgagctgggttttcctcgctgctcttttaagagacgtccactgttttgtgggcctggtggagtcgtggggggggcgtggtccagcccgggaggtccctcagactctcctgtacagacccgacatcttacgtcaggattaataatgtacactggatccgccaggccccaggcaaggggctggagtgggtggcattggtgactcatgtggaagacagaaaattgtacgcagactccgtgaggggccgattcatcatctccaaagactactccaagaatacggtgtatcttcaaatgaatggcctcgtttttgcggacacggctgtttattattgtgcgacgagggggcccccctttccgtaggaggcgatcattactacttttgtacctacgtcggggccgacggggaacccgtcggtaccg

SEQ ID NO: 462709 - DNA, 554 bp, Homo sapiens
  misc_feature: HEFZJCU01DPP83.15.86.H09.1.454.heavy.3.raw
tctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtggggttggacgtttcaaaagtaaaatgatggtgagaaaatagactacggtgcacccgtagaaaggaagattcaccatctcaagagataattcaaaaacgacggtgtatttgcaaatgaacagcctagaaaaccgaggacacagccgtctattactgtaccacagattacggaagtgcatcgacgtaaaggaggctatgtcttttgatatcgtggggcccaggggacaagtt

SEQ ID NO: 462710 - DNA, 516 bp, Homo sapiens
  misc_feature: HEFZJCU01A055T.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaacgggccgattaaccatctccagagacgattccgagaacacggtgtatcttcaaatgaacaacctgagagccgacgacacggccgtttatactgtgcgagagattcgagtgggttcggggacctcaccctggttctacttcgatctc

SEQ ID NO: 462711 - DNA, 505 bp, Homo sapiens
  misc_feature: HEFZJCU01DB1D4.27.57.F02.1.454.heavy.3.raw
agcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccagggaagggctggagttcgtggccaacataaaccaagatggaggtaaagaaaactatgtggactctgtgaagggccgattcaccatctccagagacaacgccaagaagtcactgtatctgcaaatgaacagcctgagagccgaggacacggctgtatactactgtgcgagagatcctagtcattccgcttttgatcg

SEQ ID NO: 462712 - DNA, 517 bp, Homo sapiens
  misc_feature: HEFZJCU01AL8KS.48.28.C06.1.454.heavy.3.raw
agtatacatacacgaccggtgctcgatttagagctcacgtattgggtttggggagctctgagagaggagcccagccctgggattttcaggtgttttcatttggtgatcaggactgaacagagagaactcaccatggagtttgggctgagctggctttttctagtgactatttttaaaggtgtccagtgtgaggtgcaactattggagtctgggggtggcctggtgcagccgggggggtccctgagactctcttgtgcagcctctggattcagctttagtaattatgccatgagctgggtccgccaggctccagggaaggggctggagtggatttcatctattagtggtagtggtgttaccacatactacgcagactccgtgaagggccgattcatcatctccagagacagttccaggaacacactggatttgcaaatgaacagcctgagagccgaggacacggccctatattactgtgcgaaaatcccatgatagtagtggttttttctttcgtttt

SEQ ID NO: 462713 - DNA, 491 bp, Homo sapiens; identical to SEQ ID NO: 444803
  misc_feature: HEFZJCU01AR7I7.4.57.F02.1.454.heavy.3.raw

SEQ ID NO: 462714 - DNA, 506 bp, Homo sapiens
  misc_feature: HEFZJCU01EE3QB.10.28.C06.1.454.heavy.3.raw
catagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtggagtcggggggaggcttggtacagcctggggggtccctgagactctcctgtgtagcgtctggattcacattcagtagttatagcatgaactgggtccgccaggctccagggaaggggctggagtgggtttcatatattgatagaaatagtggaaccatatactatgcagactctgtgaggggccgattcaccatctccagagacaatgccaggaattcactgtatgtaggaatagaacagtctgagagccgagaacacggctctctattactgtgcgagacgcccgaaaatagggtactacg

SEQ ID NO: 462715 - DNA, 513 bp, Homo sapiens
  misc_feature: HEFZJCU01CL21J.10.85.H08.1.454.heavy.3.raw
catagtagtgcacgaccggtgctcgatttagtatcactcagtcgcggggaggtctcagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgagggggagccggctatggttcggacctctggggccac

SEQ ID NO: 462716 - DNA, 536 bp, Homo sapiens
  misc_feature: HEFZJCU01DPUL7.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtataggctgtgtttattggggccagggagccctggtctaccg

SEQ ID NO: 462717 - DNA, 502 bp, Homo sapiens
  misc_feature: HEFZJCU01DGB4T.48.59.F04.1.454.heavy.3.raw
agtatacatacacgaccggtgctcgatttagtacacacacttagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtcttttgatgcctttgatatgtggggccaaggggacaagtggt

SEQ ID NO: 462718 - DNA, 501 bp, Homo sapiens
  misc_feature: HEFZJCU01AQW8R.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctgtctccggcagcccccagggaagggactggagcatattgggtatggtctttcacagtgggaggactgactacaacgcctccctcaggagtcgggtcaccatatcagtagacacgtccaagagccagttctcctgaagctgagggctgtgagcgccgcagacacggccgtgtattactgtgcgagactggccgcaacagactacggtggcaactcctatgcttttgatatctggggccaaggggac

SEQ ID NO: 462719 - DNA, 399 bp, Homo sapiens
  misc_feature: HEFZJCU01CY2E2.16.29.C07.1.454.heavy.3.raw
tgtactactccacgaccggtgctcgatttagagtgctacgaagggaaaggggctggagtgggtctcagctattagtattagtggtgatagcacatactacgcagactccgtgaagggccggttcaccatctccagagacaattccaagaatatgttgtatctgcaaatgaacagcctgagagccgaggacacggccgtatattactgtgcgaaagatgtaaagtgggcgctactggactcgggggcttttgatatctggggccaagggacaatggtcaccgtctcttcagcctccaccaagggcccatcggtcttccccctggcaccctgctccaggagcacctccgagagcacagcggccctgggctgcctggtcaaggactacttccgagtagtaca

SEQ ID NO: 462720 - DNA, 526 bp, Homo sapiens
  misc_feature: HEFZJCU01AOS2N.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggtttccttgttgctattttaaaaggagtccagtgtgaggtgcgtctggtggagtctggaggaggcctgatccagcctggggggtccctgagactctcctgtgcagcctctgggttcaccgtcagtcacacctacatgagttggggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggccaagggaccac

SEQ ID NO: 462721 - DNA, 508 bp, Homo sapiens; identical to SEQ ID NO: 445594
  misc_feature: HEFZJCU01AOYPR.17.25.C03.1.454.heavy.3.raw

SEQ ID NO: 462722 - DNA, 501 bp, Homo sapiens; identical to SEQ ID NO: 455940
  misc_feature: HEFZJCU01C3GG0.11.19.B08.1.454.heavy.3.raw

SEQ ID NO: 462723 - DNA, 494 bp, Homo sapiens
  misc_feature: HEFZJCU01CRWJ9.51.6.A06.1.454.heavy.3.raw
cgatcgtatacacgaccggtgctcgatttagatctactgacagggggctgagctgggttttcctcgttgctcttttaagaggtgtccagtgtcaggtgcagctggtgcagtctgggggaggcgtggtccagcctgggaggtccctgagactctcctgtgaagcctctggattcagcttcagtacgtatggtttgcgctgggtccgccaggctccaggcaagggactgcagtgggtggcatctatatcatatgaaggaagcaataaatactacgcagactccgtgaagggccgattcaccatctccagagacaatcccaagaacacactttatctgcaaatgaacaccctgagacttgaggacaacggctgtctattattgtgcgagagggagatcgatcacagcagcccctcgaagacccagcagtgatgggtttttgatgtctgggggccaaggggacaatggtcaccgtctctcagcctccaccaagggccc

SEQ ID NO: 462724 - DNA, 520 bp, Homo sapiens
  misc_feature: HEFZJCU01C8IZS.48.12.B01.1.454.heavy.3.raw
agtatacatacacgaccggtgctcgatttagtagtgtagattccgcgggcacgaccggtgctcgatttagatcgtctgtgttgggtcgggggggaggtgtggtccagcctgggaagtccctgacactgtcctgcgcagcctctggattcaccttcaccaccttttcgtatgcacttttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctgggtcaccgtctcctcagcctccaccaagggcccatccggtcttcccctggccgccctgctccaggagcacctccgagagcgacacgcggccct

SEQ ID NO: 462725 - DNA, 523 bp, Homo sapiens
  misc_feature: HEFZJCU01EM6DD.4.57.F02.1.454.heavy.3.raw
agcactgtagcacgaccggtgctcgattagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgacctagtggggccagggaaccctggtcaccgtctcctcagcttccaccaagggcccatcggtccttcccctggccgcctcgctccaggagcacctctcgggggcacacggccggtcccgg

SEQ ID NO: 462726 - DNA, 534 bp, Homo sapiens
  misc_feature: HEFZJCU01B9ITO.3.70.G04.1.454.heavy.3.raw
agacgcactccacgaccggtgctcgatttagtgtagtgtgaagggaaagggggggagaggagcccaccactgggattccgaggtgtttccattcggtgatcagcactgaacacagaggactcaccatggagttttggctgagctgggttttccttgttgctatttcaaaaggtgtccagtgtgaggtgcagctggtggagactggaggaggcttgatccagcccggggggtccctgagactctcctgtgaagtctctgggttcactgtcagtagcaactacatgaactgggtccgccaggctccagggaaggggccggagtgggtctcaattatttatggcgatggtagtacgtactacgcagactccgtgcagggccgattcaccatctccagagacaatttcaagaatacgttgctccttcaaatgaacaacctgagaaccgaggacacggccgtatattattgtgcgagtagtacggtggtgaatgtgggtgttaactggggccgtgggaacctggtcaccgtctcctcag

SEQ ID NO: 462727 - DNA, 535 bp, Homo sapiens
  misc_feature: HEFZJCU01ECRB6.17.28.C06.1.454.heavy.3.raw
  modified_base (523)..(523): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaatggctgtgtttattggggccaggganccctggtcaccg

SEQ ID NO: 462728 - DNA, 512 bp, Homo sapiens; identical to SEQ ID NO: 445279
  misc_feature: HEFZJCU01EKE7P.17.33.C11.1.454.heavy.3.raw

SEQ ID NO: 462729 - DNA, 507 bp, Homo sapiens
  misc_feature: HEFZJCU01D1IGL.11.6.A06.1.454.heavy.3.raw
cgagagataccacgaccggtgctcgatttagatctactgacagggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtctgggggaggcttggtaaagccgggggggtcccttagactctcctgtgcagcctctggcatcactttcagtgacgcctggatgagctgggtccgccaggctccagggaaggggctggagtgggttggccgtattaaaagcgaggctgctggtgggacaacagactacgctgcacccgtgaagggcagattcaccatctccagagatgattcaaggagcacagtgtttctacaaatgaacagcctgactgccggggacactgccgtgtattactgtgccagcagcagcacctggccactattatttctttcg

SEQ ID NO: 462730 - DNA, 518 bp, Homo sapiens
  misc_feature: HEFZJCU01A77XR.53.61.F06.1.454.heavy.3.raw
cgcgtatacacacgaccggtgctcgatttagctacgctctaagggaaaggggtcggtgatcagcactgaacacagaggactcaccatggagtttgggctgagctgggttttcctcgttgctcttttaagaggtgtccagtgtcaggtgcacctagtggagtctgggggaggcgtcgtccaccctggggggtccctgagactctcctgtgcagcctctggattcaccttcagagtctatggcatgcactgggtccgccaggctccaggcaaggggctggagtgggtggcacttatatcagatgatggaagtgatacatactatggagactccgtgaagggccgattcaccatctcgagagacaattccaggaacacgctgtatctgcaatgaacggcctgagagctgaggacacggctgtgtattactgtgcgaaacggtttgagtgggaagttaggggctgagtacggtatggacgtcgtggggccgaaggggaccgacggtccaccggtcctcctcg

SEQ ID NO: 462731 - DNA, 502 bp, Homo sapiens
  misc_feature: HEFZJCU01C59PZ.52.20.B09.1.454.heavy.3.raw
cgcagtacgacacgaccggtgctcgatttagtgtagtgtgaaggggctgggagacgagcccagcactggaagtcgccggtgtttccattcggtgatcatcactgaacacagaggactcaccatggagtttgggctgagctgggttttcctcgttgctcttttaagaggcgtccagtgttatgtgcagctggtggagtctgggggaggcgtggtccagcctgggaggtccctgagactcgcctgtaaaccgtccggatttaccttcagtaactatgcaatgcactgggtccgccaggctccaggcaaggggctggactgggtggcagctatatcatttgatggaagcaataaatactacgcagactccgtgaagggccgattcaccatttccagagacagctccgataacacggtctatctgcgaatgaacagcctgagacctgaggacacggcttctttttactgtgcgccaggaagcagtggctggccacatgatgctttt

SEQ ID NO: 462732 - DNA, 511 bp, Homo sapiens; identical to SEQ ID NO: 452200
  misc_feature: HEFZJCU01C4OZ9.16.71.G05.1.454.heavy.3.raw

SEQ ID NO: 462733 - DNA, 499 bp, Homo sapiens; identical to SEQ ID NO: 453198
  misc_feature: HEFZJCU01CK50P.11.71.G05.1.454.heavy.3.raw

SEQ ID NO: 462734 - DNA, 510 bp, Homo sapiens
  misc_feature: HEFZJCU01DRSX8.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggacgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgactttctggggccaggggacg

SEQ ID NO: 462735 - DNA, 516 bp, Homo sapiens
  misc_feature: HEFZJCU01CE5QC.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgaccctgggccagggaaccctggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 462736 - DNA, 517 bp, Homo sapiens
  misc_feature: HEFZJCU01BPUVL.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtcccccaacacagggactgcagtggattggatacatctacttcagtgggaaccccaactacaacccctccctcaggagtccagtcgccatatccctggactcgtccaacaaccagatctccctgacgatgacatctgtgaccgctgcggacacagccgtttattactgtgcgcgatctgggcgactcagtgactatggtatggacgtctgggggccaagggaccacggtcatcgtctcctcagcctccaccaacgggcccatcggtcttccccctggccta

SEQ ID NO: 462737 - DNA, 514 bp, Homo sapiens
  misc_feature: HEFZJCU01C9W32.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggcgccctgctcagagcacctctggggcgacgagcggtcccg

SEQ ID NO: 462738 - DNA, 483 bp, Homo sapiens
  misc_feature: HEFZJCU01A1Z04.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaacgaagtcactgtatctacaaatgaacaggcctgagagccgaggacacggccgtgtattactgtgtgagagataagtccgggtatcacttggatagaagtgcttattacattgactactggggccagggaaccctcgtcaccgtctcctcagcctccaccaaggcccatcggtcttcccctggcaccctcctccaagagcacctctgggggcacagcggccctgggctgcctggtcaaggactacttcctagagacacg

SEQ ID NO: 462739 - DNA, 509 bp, Homo sapiens
  misc_feature: HEFZJCU01BS0A4.51.36.D03.1.454.heavy.3.raw
cgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactactggggctggatccggcagcccccgggaaggggctggattggattggcagtatcagttatactgggaccaccttcttcaagtcgtcgctcaagagtcgagtcaccatgaccgcggacacgtccaaggaccagttctccctgaagctgacctctgtgaccgccgcagacacggctttgtatttctgtgctagatataatgtgggtgacagtggtgcctactacggagtctttagattagtttggggccaaggcacgtaac

SEQ ID NO: 462740 - DNA, 507 bp, Homo sapiens
  misc_feature: HEFZJCU01B9XCW.4.67.G01.1.454.heavy.3.raw
  modified_base (472)..(472): a, c, t, g, unknown or other
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggcttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggacacggccacatattactntgcgaaagatctcgggctggttccgcggtccgggt

SEQ ID NO: 462741 - DNA, 483 bp, Homo sapiens
  misc_feature: HEFZJCU01BJVY3.19.67.G01.1.454.heavy.3.raw
tactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagactttttctcagaacacactgtctcttcaaatgaacagcctgagggccgaggacacggccgtctattattgtgtgagagtttatggcgatggctggtggacagatcactggggccagggaaccctggtcaccgtctcctcagcctccaccaagggcccatcggtcttcccctggcgccctgctccaggagcacctccgagagcacagcggcccgtggggctgcctggtcaaggactacttcccacgagagta

SEQ ID NO: 462742 - DNA, 516 bp, Homo sapiens
  misc_feature: HEFZJCU01ESCME.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaactcctactacggtctggacgtctgtggccaggggaccg

SEQ ID NO: 462743 - DNA, 489 bp, Homo sapiens
  misc_feature: HEFZJCU01BBFOL.47.85.H08.1.454.heavy.3.raw
agctcacgtacacgaccggtgctcgatttagtatcactcagtcggggggaggcgtggtccagcccgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctccgagagcacagcggccctgggctgcctggtcaaggactacttcctacgtgagct

SEQ ID NO: 462744 - DNA, 492 bp, Homo sapiens
  misc_feature: HEFZJCU01C7USB.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatccggtcttccccctggcgccctgcctccaggagcacctccgagagcacagcggccctgggctgcctggtcaaggactacttcctacgtgagct

SEQ ID NO: 462745 - DNA, 525 bp, Homo sapiens
  misc_feature: HEFZJCU01E113Q.53.76.G10.1.454.heavy.3.raw
cgcgtatacacacgaccggtgctcgatttagtcactcatacaggggttgggggcaacttataaacccaaaaggaatggccatgcagcgggtagggacaatacagacagatctcagcctgaaatggagcctcagggcacaggtgggcacggacactgtccacctaagccaggggcagacccgagtgtccccgcagtagacctgagagcgctgggcccacagcctcccctcggtgccctgctacctcctcaggtcaggcctggacatcccgggtttccccaggcctggcggtaggtttggggtgaggtctgtgtcactgtggtatgacgatttttggcgtggtttttccttcactattactcccactactacggtttggacgtctggggccaagggaccacggtcaccgtctcctcagcctccaccaagggcccatcggtcttcccctcggcaccctcctccaagagcacctctgggggcacagcggccctgggctgcctggtcaaggactacttcctcgtactgcg

SEQ ID NO: 462746 - DNA, 519 bp, Homo sapiens
  misc_feature: HEFZJCU01EOUF3.16.15.B04.1.454.heavy.3.raw
tgtactactccacgaccggtgctcgatttagacagtatatatccgcggggagctctgagagaggagcccagccctgggattttcaggtgttttcatttggtgatcagggctgaacagagagaactcaccatggagtttgggctgagcgtggcgttttcttaggtggctattttaaaaggtgtccagtgtgaggtgcagctgttggagtctgggggaggcttggtacagcctggggggtccctgagactctcctgtgcagcctctggattcatctttagcagctatgtcatgacctgggtccgccaggctccagggaaggggctgggagtgggtctcagttattggtggtagtggttataccacatactacgcagactccgtgaagggccggttcaccatctccagagacaattccaagaacacactatatctgacaatgaacagcctgagagccgaggacacggccgtatattactgtgacgaaaggccaaggggtatagcagtggctgggtacctaac

SEQ ID NO: 462747 - DNA, 515 bp, Homo sapiens
  misc_feature: HEFZJCU01CVVGZ.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccaggggaactctggtcaccggtctccgcagcctccaccaaggcccc

SEQ ID NO: 462748 - DNA, 526 bp, Homo sapiens; identical to SEQ ID NO: 452033
  misc_feature: HEFZJCU01BBF3H.10.85.H08.1.454.heavy.3.raw

SEQ ID NO: 462749 - DNA, 519 bp, Homo sapiens; identical to SEQ ID NO: 445330
  misc_feature: HEFZJCU01C4H3S.7.78.H01.1.454.heavy.3.raw

SEQ ID NO: 462750 - DNA, 487 bp, Homo sapiens
  misc_feature: HEFZJCU01AF0LU.17.36.D03.1.454.heavy.3.raw
cgtagactagcacgaccggtgctcgatttagctgcgtcacgatctctcttggggctcagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtaccgcctggggggtccctgagactctcctgtagagcctctggattcgccttcagtacctacagcatgaactgggtccgccaggttccagggaagggtctggagtgggttgcatacattagtagtagtgatagttccatatactacgcagactctgtgaagggccgattcaccatcctccagagacagtgccaagaactcactgtatctgcaaatgaacagccttagagacgacgacacggctgtgtattactgtgcgagagatccg

SEQ ID NO: 462751 - DNA, 518 bp, Homo sapiens
  misc_feature: HEFZJCU01CJ2HS.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgacccacgaactcctccataaacacagcctacatggagttgaggagcctgacatctgacgacacggccgtctattactgtgcgagacgtcccacgatccgggtgaggcctacggccagccggcctttggactttctgggggccaggggacg

SEQ ID NO: 462752 - DNA, 502 bp, Homo sapiens
  misc_feature: HEFZJCU01D5THY.17.78.H01.1.454.heavy.3.raw
  modified_base (452)..(452): a, c, t, g, unknown or other
cgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagcctgggcctcagtgaaggtttcctgcaaggcttctggatacaccttcacgacgtatgctattcactgggtacgccaggcccccggacacagccttgagtggatgggatggatgaacgttgacaatgggaatacgagatattcacagaaattccagggcagagtcaccattaccagggacacatccgcgaacacagcctacatggagctgacgggcctgacatctgaagacacggctttanattactgtgcgcgagatggctggcacagagggcacaactggctcgacccg

SEQ ID NO: 462753 - DNA, 483 bp, Homo sapiens
  misc_feature: HEFZJCU01EQWV7.19.13.B02.1.454.heavy.3.raw
tactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaatgaacagcctgagagctgaggacacggctgtgtattactgtgcgaggcggt

SEQ ID NO: 462754 - DNA, 514 bp, Homo sapiens
  misc_feature: HEFZJCU01C14JO.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttattatagtagtggtagtacatactccgcagactccgtgaggggccattcaccatctccagagacaattccaagaacacgctgtttcttcaaatgaacagcctgagagccgatgacacggccgtgtattactgtgcgagagatggggcccacgaacgttactacgctatggacgtctggggccaagggta

SEQ ID NO: 462755 - DNA, 517 bp, Homo sapiens
  misc_feature: HEFZJCU01ANN2I.51.26.C04.1.454.heavy.3.raw
cgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtctggggccaagggaccacggtcaccgtctccttagcctccaccaagggcccatcggtcttcccctggcgcctgctc

SEQ ID NO: 462756 - DNA, 514 bp, Homo sapiens
  misc_feature: HEFZJCU01ADEXF.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctagatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttcgtggggccgagggaacccgtc

SEQ ID NO: 462757 - DNA, 506 bp, Homo sapiens
  misc_feature: HEFZJCU01CYJJ8.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctgggggggctggtccagcctgggaggtccctgagactctcctgtgcaggctctggattcaccttcagtaactacggcgtgcactgggtccgccaggctccaggcaagggcttggagtggctggcagttgtttcatctgaaggagtgttcaatactatacagactccgtgaagggccgattcaccatctccagagacaattccaagaacacgatgtatctgcaaatggacagcctaagagttgaggacacggctgtttattactgtacgaaagaggggggatacgagtggcagctccaagtacttac

SEQ ID NO: 462758 - DNA, 428 bp, Homo sapiens
  misc_feature: HEFZJCU01DO9MP.40.53.E09.1.454.heavy.3.raw
tctagcgactcacgaccggtgctcgatttagagagagtgtgttgggtttggatacaactttaccatctactggatcgcctgggtgcgccagatgcccgggaaaggcctagagtgggtgggaatcgtctatcctgacgactctgataccagatacagcccgtccttccaaggccaggtcaccatctcagccgacaagtccgtcaataccgcctacctgcagtggagcagtctgcaggcctcggacaccgccatgtacttctgtgcgagagggttcggggatgactactggggccagggaaccctggtcaccgtctcttcagcttccaccaagggcccatcggtcttcccctggcgccctgctccaggagcacctctgggggcacagcggccctgggctgcctggtcaaggactacttccagtcgctaga

SEQ ID NO: 462759 - DNA, 512 bp, Homo sapiens; identical to SEQ ID NO: 451632
  misc_feature: HEFZJCU01CNF1D.4.23.C01.1.454.heavy.3.raw

SEQ ID NO: 462760 - DNA, 492 bp, Homo sapiens
  misc_feature: HEFZJCU01EIFSE.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctgggccagggaaccctggtcatcgtctcctcagcctccaccaagggcccatcggtcttcccctgcgccctgctccaggagcacctccgagagcacagcggccctgggctgcctggtcgaaggactacttcctacgtgagctctgc

SEQ ID NO: 462761 - DNA, 503 bp, Homo sapiens
  misc_feature: HEFZJCU01DOH2Z.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagtctacggcagcggcctttgacttctc

SEQ ID NO: 462762 - DNA, 313 bp, Homo sapiens; identical to SEQ ID NO: 444447
  misc_feature: HEFZJCU01DHN9P.7.10.A10.1.454.heavy.3.raw

SEQ ID NO: 462763 - DNA, 517 bp, Homo sapiens
  misc_feature: HEFZJCU01BTM6G.13.76.G10.1.454.heavy.3.raw
tcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccaagggaccg

SEQ ID NO: 462764 - DNA, 523 bp, Homo sapiens; identical to SEQ ID NO: 448340
  misc_feature: HEFZJCU01DZNO1.12.33.C11.1.454.heavy.3.raw

SEQ ID NO: 462765 - DNA, 483 bp, Homo sapiens; identical to SEQ ID NO: 444924
  misc_feature: HEFZJCU01BFWD9.10.35.D02.1.454.heavy.3.raw

SEQ ID NO: 462766 - DNA, 517 bp, Homo sapiens
  misc_feature: HEFZJCU01DYIUK.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctgggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacgggccatgtattactgtgtggggcatttacttgaccctggggccggggaacccgtggtcaccgt

SEQ ID NO: 462767 - DNA, 533 bp, Homo sapiens
  misc_feature: HEFZJCU01AXI9Q.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaagggcccatcggtcttcccctggcaccctcctccaagagcacctctgggggcac

SEQ ID NO: 462768 - DNA, 488 bp, Homo sapiens
  misc_feature: HEFZJCU01ELD0P.47.85.H08.1.454.heavy.3.raw
agctcacgtacacgaccggtgctcgatttagtatcactcagtcggggggaggcgtggtccagcctgggacgccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctccgagagcacagcggccctgggctgcctggtcaaggactacttcctacgtgagct

SEQ ID NO: 462769 - DNA, 531 bp, Homo sapiens
  misc_feature: HEFZJCU01DK5V1.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacggtgaatcttcaaatgaacagcctgagaaccgaggacacggccgtatattattgtataggttatggtggtaattcgggcccctggggccaggggaaccgtggtcaccgtctcctcagcctccaccg

SEQ ID NO: 462770 - DNA, 501 bp, Homo sapiens; identical to SEQ ID NO: 453820
  misc_feature: HEFZJCU01BT5ZQ.3.20.B09.1.454.heavy.3.raw

SEQ ID NO: 462771 - DNA, 515 bp, Homo sapiens
  misc_feature: HEFZJCU01B19LO.48.53.E09.1.454.heavy.3.raw
agtatacatacacgaccggtgctcgatttagagagagtgtgttgggtttgggggctttctgagagtcatggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactgggcctggatccgccagccccccgggaagggactggaatggattgggagtatctattatacagggagcacctactacaacccgtccctcaagagtcgagtcaccatctccgcagacacgtccaagaaccagttctccctgaggctgagctctgtgaccgccgcagacacggctgtctattactgtgcgagaagtgggtcgtggcagtggctggtacgtggctctcagtggttcgacccctggggccagggatacctggtcaccg

SEQ ID NO: 462772 - DNA, 521 bp, Homo sapiens
  misc_feature: HEFZJCU01E1H7F.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgaccctggggccagggaacccaggtcaccgtctcctcagcctccaccaagggcccatccgtcttccccctggcgccctgctccaggagcgacctccgagagcacagcggccctgggctgcctggtcaagactactcctaccg

SEQ ID NO: 462773 - DNA, 376 bp, Homo sapiens
  misc_feature: HEFZJCU01ER2BW.49.72.G06.1.454.heavy.3.raw
agtcgagagacacgaccggtgctcgatttagctacgactgcaagggaaaggggctggagtgggtggacaacataaaccaagatggaactgtggaagactacatagactctgtgaagggccgattcaccatctccagagacaacgccaagaattcactgtttctgcacatgagcagtctgagagtcgaggacacggccttctattattgtgtgagtcagagtggcccaacccattggagccagggaaccctagtcagcgtctcctcagcctccaccaagggcccatcggtcttccccctggcgccctgctccaggagcacctccgagagcacagcggccctgggctgcctggtcaaggactacttcctctctcgact

SEQ ID NO: 462774 - DNA, 504 bp, Homo sapiens
  misc_feature: HEFZJCU01DJLKF.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttcccctggcaccctcctccaagagcacctctgggggcacagcggccctgggctgcctggtcaggactacttcctacgtcgtat

SEQ ID NO: 462775 - DNA, 517 bp, Homo sapiens
  misc_feature: HEFZJCU01E1JEI.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggactctggtcaccgtctccgcagcctccaccaacgggcccatcc

SEQ ID NO: 462776 - DNA, 483 bp, Homo sapiens; identical to SEQ ID NO: 444639
  misc_feature: HEFZJCU01B8T58.11.23.C01.1.454.heavy.3.raw

SEQ ID NO: 462777 - DNA, 324 bp, Homo sapiens
  misc_feature: HEFZJCU01CWMPC.18.17.B06.1.454.heavy.3.raw
tacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctccccaccctccaccaagggcccatcggtcttccccctggcaccctcctccaagagcacctctgggggcacagcggccctgggctgcctggtcaaggactacttcccatactcgta

SEQ ID NO: 462778 - DNA, 498 bp, Homo sapiens
  misc_feature: HEFZJCU01CX0L2.52.15.B04.1.454.heavy.3.raw
cgcagtacgacacgaccggtgctcgatttagacagtatatatccgcggggtccagtgtcaggtgcagctggtggagtctgggggaggcgtggtccagcctgggaggtccctgagactctcctgtgcaggctctgcatttcccttcaataactatgctatcgattgggtccgccaggctccaggcaagggactggagtgggtggcagtaatatcagctgatggaggcactaaatattacgctgattctgcgaggggccgattcaccatatccagagacaactcccaagatgtgatatatctacaaatgaacagcctgagacctgaggacacggctgtatattattgtgcgtcagggggcagtgcctggccacgtgatgctttgatttctggggccaagggacattcgtcaccgtctcctcagcctccaccaagggcccatccggtcttccccctggccaccctccctccaagagcacctctgggggcacagcggccctc

SEQ ID NO: 462779 - DNA, 492 bp, Homo sapiens
  misc_feature: HEFZJCU01EZQGH.53.55.E11.1.454.heavy.3.raw
cgcgtatacacacgaccggtgctcgatttagcactcgcacgttgggtttgggggagcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcagggcagggtctccatgaccagggacaggggccatcagaacagcctacatggagctgaacagactgacatctgacgacacggccgtttattattgtgtgagagaggacccgatgaccg

SEQ ID NO: 462780 - DNA, 528 bp, Homo sapiens
  misc_feature: HEFZJCU01CC1J0.13.28.C06.1.454.heavy.3.raw
tcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagcctggggggtccctgagactctcctgtgtagcctctggatttgtttttagtgactattggatgagttgggtccgccaggctccagggaaggggctggagtgggtggccaacataaagtacgatgaagttgagataaattatttggactctgtgaagggccgattcaccatctcgagggacaacgccaagaactcgctgtatctgcaaatggagagcctgagagccgaggacacggctgtatattattgtgtgagattagcgcactactttgactactgggccagggaaccctggtcaccgt

SEQ ID NO: 462781 - DNA, 519 bp, Homo sapiens; identical to SEQ ID NO: 452709
  misc_feature: HEFZJCU01CUBL2.3.82.H05.1.454.heavy.3.raw

SEQ ID NO: 462782 - DNA, 519 bp, Homo sapiens
  misc_feature: HEFZJCU01DXZZL.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtgtcatagacctaggatacaacgacggtggtacctggtattcg

SEQ ID NO: 462783 - DNA, 512 bp, Homo sapiens
  misc_feature: HEFZJCU01CAAVR.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaacgggccgattcaccatctccagagacaactccaggaacacaatgtattggactgaacagcctaagtcctgaggacacgggtgtatactactgtacgaaggagggggaaccagcggagttccaagtactcctttg

SEQ ID NO: 462784 - DNA, 518 bp, Homo sapiens
  misc_feature: HEFZJCU01EI80B.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataaccgtacgcctggtattacc

SEQ ID NO: 462785 - DNA, 495 bp, Homo sapiens
  misc_feature: HEFZJCU01CA02P.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaacgggcccatcggtcttcccctcggcgccctgctccaggagcacctccgagagcacagcggccctcgggctgcctggtcaaggactaccttcccacgagagta

SEQ ID NO: 462786 - DNA, 532 bp, Homo sapiens
  misc_feature: HEFZJCU01EZL1K.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatattttcgacccctggggccagggaacccacggtcaccgtctccttcagcctccaccaagggccccatccgtcttccccctggtccgccctcgctccacggagcacctccgagagcgacagcggccctcggggctgcctggtcaaggactactcctacg

SEQ ID NO: 462787 - DNA, 519 bp, Homo sapiens; identical to SEQ ID NO: 446650
  misc_feature: HEFZJCU01DK0R6.13.76.G10.1.454.heavy.3.raw

SEQ ID NO: 462788 - DNA, 537 bp, Homo sapiens
  misc_feature: HEFZJCU01DJ4PF.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatccctgaaagcgtcaactactactactacggtatcggacctctggggaccg

SEQ ID NO: 462789 - DNA, 518 bp, Homo sapiens
  misc_feature: HEFZJCU01DYQGN.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtcttcccctggcgccctgctccaggggcacctcccgacgagcacacgcggcccgtcgggcgtcgcctcggtcgaacggacgtaaccttaccttaccgttcgtact

SEQ ID NO: 462790 - DNA, 510 bp, Homo sapiens
  misc_feature: HEFZJCU01BZ40F.12.11.A11.1.454.heavy.3.raw
atacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagagtctcctgtacaacctctggattcatgtttagtagtcattggatgaactgggtccgccaggctccagggaaggggctggagtgggtggccaacataaagcaagatggaagtgagaaatactatgtggactctgtgaagggccgattcacaatctccagagacaacgccaagaactcactgtatctgcaaataaacagcctgaaagccgaggacacggctgtgtatttctgtgcgaggacgtcctacggtgacaaatttattcaaaccagac

SEQ ID NO: 462791 - DNA, 491 bp, Homo sapiens
  misc_feature: HEFZJCU01EH3MS.52.2.A02.1.454.heavy.3.raw
cgcagtacgacacgaccggtgctcgatttagactcatctacaggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaggtggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcatatgatggaagtaaaatatactatgtagactccgtgaagggccgattcatcatctccagagacaattccgagaacaccctgtatctgcaaatgaacagcctgagagctgaggacacggctgtgtattactgtgcgaacttaatcacggaggacaac

SEQ ID NO: 462792 - DNA, 502 bp, Homo sapiens
  misc_feature: HEFZJCU01CM24G.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaaggcccatcggtcttcccctcggcgccctgctccaggagcacctccgacgagcacacgcggcccgtcgggcgtgcctggtcgaagggactacctttcccaccgagacgta

SEQ ID NO: 462793 - DNA, 538 bp, Homo sapiens
  misc_feature: HEFZJCU01AS52A.13.76.G10.1.454.heavy.3.raw
tcacgtactacacgaccggtgctcgatttagtcactcatacagggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtctggaggaggcttggtccagccgggggggtccctgagactctcatgtgcggcctctgggctcaccgtcaacaccaactacatgagctgggtccgccaggctccagggaagaggccggagtgggtctcagttatttatgtcgacggtgccacattctacgcagactccgtgaggggccggttcaccatcctccagagacaattccaagaacacggtgtatcttcaaatgaacgacctgagagtcgaggacacggccgtctattactgtgcgaaagatgcagagagggccccgtaatggggcctggtggagggttcttctttgactgctggggccagggaacccg

SEQ ID NO: 462794 - DNA, 507 bp, Homo sapiens
  misc_feature: HEFZJCU01CM7AT.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctcaccaagggcccatcggtcttccccctggcgccctgctccaggacg

SEQ ID NO: 462795 - DNA, 515 bp, Homo sapiens
  misc_feature: HEFZJCU01DROVU.48.19.B08.1.454.heavy.3.raw
agtatacatacacgaccggtgctcgatttagtgagtcagtaaggggggatctcatgtgcaagaaaatgaagcacctgtggttcttcctcctcctggtggcggctcccagatgggtcctgtcccagctgcagctgcaggagtcgggcccaggactggtgaagccttcggagaccctgtccctcacctgcactgtctctggtgactccatcagcagtagtacttactactggggctggatccgccagcccccagggaaggggctggagtggattgggagtatctattatagtgggagtacctactacaacccgtccctcaagagtcgactcaccatatccgtagacacgtccaagaaccagttctccctgaagctgagctctgtgaccgccgcagacacggctgtgtattactgtgcgagggggccgggatattgttatagaaccacctgctatctgagctggttcgactgctggggccagggaaccctggtcaccgtctcctcagcctccaccaac

SEQ ID NO: 462796 - DNA, 403 bp, Homo sapiens; identical to SEQ ID NO: 445029
  misc_feature: HEFZJCU01DOP06.10.77.G11.1.454.heavy.3.raw

SEQ ID NO: 462797 - DNA, 520 bp, Homo sapiens
  misc_feature: HEFZJCU01A3WOW.19.86.H09.1.454.heavy.3.raw
tactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttcccctggcgccctgctccaggagcacctccgagagcacagcggccctggg

SEQ ID NO: 462798 - DNA, 505 bp, Homo sapiens
  misc_feature: HEFZJCU01CAKBN.52.34.D01.1.454.heavy.3.raw
cgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgccccttggactggttatttcgactcctggggccagggaaccctagtagccgtctcctcagcctccaccaagggcccatcggtcttcccctggcaccctcctccaagagcacctctgggggcacagcggccctgggctgcctggtcaaggactacttcctatacgatcg

SEQ ID NO: 462799 - DNA, 493 bp, Homo sapiens
  misc_feature: HEFZJCU01AX092.11.71.G05.1.454.heavy.3.raw
cgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagatttctata

SEQ ID NO: 462800 - DNA, 527 bp, Homo sapiens
  misc_feature: HEFZJCU01CNDOZ.3.23.C01.1.454.heavy.3.raw
agacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtagactgctggtgagacaacagactacgctgctgccttcagaggcagattcaccatcttcagagatgaatcacagagcactctgtttctgcaatgaacagcctggaagacgcggacacagccatgtattattgtacattaggacactatacgtcccgttgggggcccaggggaaccctcgtccaccgttctccctcacgcctccacccgaagggccccatccggtcctttcccctcggccgtcccg

SEQ ID NO: 462801 - DNA, 531 bp, Homo sapiens
  misc_feature: HEFZJCU01DD6ZB.22.85.H08.1.454.heavy.3.raw
acatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctggggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacgggccatgtattactgtgtgggggcatttacttgacccctgggggccggggaacccgtggtcaccgtctccccaccctccaaccg

SEQ ID NO: 462802 - DNA, 576 bp, Homo sapiens
  misc_feature: HEFZJCU01D5F7M.52.14.B03.1.454.heavy.3.raw
cgcagtacgacacgaccggtgctcgatttagtgtgagtagttcccggggggacctcctgtgcaagaacatgaagcacctgtggttcgtcctcctgctggtggcggctcccagatgggtcctgtcccagctgcaactgcaggagtcgggcccaggactggtgaagccttcggagaccctgtccctcacctgcactgtctctggtggctccatcagcagtagtgattactactggggctggatccgccagcccccagggaaggggctggagtggattgggagtgtcttttatagtggaaacacctactacaacccgtccctcaagagtcgagtcaccatatcagtagacacgtccaagagccagttctccctgaagctgacgtctctgaacgccgcggacacggccgtttattactgtgcgagtaccccggaacctttttacgtatttttggagtggatactataccggtatggggtccttttgacttcgtggggtccgacgggaacccgttgggtcaccggttccttccctcacgccctcccaaccgaacggggcccacgtcggtccttcccccttc

SEQ ID NO: 462803 - DNA, 507 bp, Homo sapiens
  misc_feature: HEFZJCU01C0RW4.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaagggctggagtgggtggccagcatgaacggagatggaagtcaaaagaactatgtggactctgtgaagggccgattcaccatctccagagacaacgcaagaactcactgtatctgcaaatgaacagcctaagacccgaggacacggctgtgtattactgtgcgagagaccgctactgggggcccggagccctggt

SEQ ID NO: 462804 - DNA, 486 bp, Homo sapiens; identical to SEQ ID NO: 462601
  misc_feature: HEFZJCU01BFLTW.8.33.C11.1.454.heavy.3.raw

SEQ ID NO: 462805 - DNA, 524 bp, Homo sapiens
  misc_feature: HEFZJCU01DFA9R.17.33.C11.1.454.heavy.3.raw
cgtagactagcacgaccggtgctcgatttagagtgagctcgttgggtttgggctcaactctcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctccaccaagggcccatcggtcttccccctggcaccctcctccaagagcacctctgggggcacagcggccctgggctgcctggtc

SEQ ID NO: 462806 - DNA, 510 bp, Homo sapiens
  misc_feature: HEFZJCU01CSAMM.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgacgcctacggcagcggcctttgacttctggggccaggggacg

SEQ ID NO: 462807 - DNA, 395 bp, Homo sapiens; identical to SEQ ID NO: 459317
  misc_feature: HEFZJCU01C9A3G.18.31.C09.1.454.heavy.3.raw

SEQ ID NO: 462808 - DNA, 481 bp, Homo sapiens
  misc_feature: HEFZJCU01EYB3W.49.4.A04.1.454.heavy.3.raw
  modified_base (447)..(447): a, c, t, g, unknown or other
agtcgagagacacgaccggtgctcgatttagagtagtgatcaggggctctgggagaggagcccagcactagaagtcggcggtgcttccattcgatgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcttgtgctgcctctggattcaccttcagggtctatgacatgcactgggtccgccaggctccaggcaaggggctggagtgggtggcatttatctcatatgatggaagcaagatatactacattgactccgtgaagggccgattcatcatctccagagacaactccgagaacacactgtatcttcaaatgaacaggttgagagctgaanacacggctttatattactgtgcgaacttatcaac

SEQ ID NO: 462809 - DNA, 498 bp, Homo sapiens; identical to SEQ ID NO: 449655
  misc_feature: HEFZJCU01D6RNQ.48.34.D01.1.454.heavy.3.raw

SEQ ID NO: 462810 - DNA, 521 bp, Homo sapiens
  misc_feature: HEFZJCU01C1O21.12.40.D07.1.454.heavy.3.raw
atacgacgtacacgaccggtgctcgatttagtgatagagcgtaacacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggcgaggggaccctggtcatcgtctcccacgcctccaccaacgggcccatcggtcttcccctggccg

SEQ ID NO: 462811 - DNA, 534 bp, Homo sapiens
  misc_feature: HEFZJCU01DMWYK.49.86.H09.1.454.heavy.3.raw
agtcgagagacacgaccggtgctcgatttagtgctatagacttgggtttgggggagtctccttcaccacccagctgggatctcagggcttccttttctgtcctcctccaggatggggtcaaccgccatcctcgccctcctcctggctgttctccaaggggtctgtgccgaggtgcaactggtgcagtccggagcagaagtgaaaagcccggggagtctctgaggatctcctgtaagatttctggagacaccttaaccacctattggatcagctgggtgcgccagatgcccggtaaaggcctggaatggatggggatgattgatcccagtgactcttttaccacgtacggcccgtccttccaatggcacgtcaccatctcagctgacaagtcccaaggagtgcctccctggagtggaccagcctgagggcctcggacaccgccatgtattactgtgcaatgggggtcgggggagcagtgtctggcaattattactactactctgtggacgtctggggccgagggacctcggtccg

SEQ ID NO: 462812 - DNA, 517 bp, Homo sapiens
  misc_feature: HEFZJCU01EGH1R.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccactcagtcagctggttcgaccctgggccagggaacctggtcaccgtctcctcagcctccaccagggcccatcggtcttcccctggcaccctcctccaagagcacctcgtgggggcacagcggccctgggctgcctggtcaaggactacttccgagtagtactacg

SEQ ID NO: 462813 - DNA, 528 bp, Homo sapiens
  misc_feature: HEFZJCU01B75ZB.10.85.H08.1.454.heavy.3.raw
catagtagtgcacgaccggtgctcgatttagtatcactcagtcgcgggggagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctgggagtgggtggccaccataaaggaagatggaagtgagaactactttgtgggctctgtgaagggccgattcaccatctccagagacaacgccaagaagtcactgtatctgcaaatgaacgatgtgagagtcgaggacacgggctgtatatttctgtgcgaggggagccgggctatggttcggacctcgtgggggccaggggaacccctggtctaccg

SEQ ID NO: 462814 - DNA, 480 bp, Homo sapiens
  misc_feature: HEFZJCU01DS2SF.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctctgggggcacagcggcctgggctgcctggtcaaggactacttctagagacacg

SEQ ID NO: 462815 - DNA, 492 bp, Homo sapiens
  misc_feature: HEFZJCU01BRDB1.51.52.E08.1.454.heavy.3.raw
cgatcgtatacacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagcctggggcctcagtgaaggtctcctgcaagacttctggatacaccttcaccgactactatatgcactgggcgcgacaggcccctggacaagggcttgagtggatgggatggatcgaccctaagaatggtgccacaaactatgcacagacttttcagggctgggtcaccatgaccagcgacacatctagcaacacagtctacatggagttgaccagcctgaccgacacggccgtgtatttttgtgtgagagatttttcggactaatccagagacccctgtc

SEQ ID NO: 462816 - DNA, 482 bp, Homo sapiens; identical to SEQ ID NO: 444503
  misc_feature: HEFZJCU01EFNWP.7.10.A10.1.454.heavy.3.raw

SEQ ID NO: 462817 - DNA, 491 bp, Homo sapiens; identical to SEQ ID NO: 453925
  misc_feature: HEFZJCU01EJ5IM.10.34.D01.1.454.heavy.3.raw

SEQ ID NO: 462818 - DNA, 459 bp, Homo sapiens
  misc_feature: HEFZJCU01C0311.4.6.A06.1.454.heavy.3.raw
agcactgtagcacgaccggtgctcgatttagatctactgacagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcaccaccgcctacctgcagtggagcagcctgaaggcctcggacaccgccatgtattactgtgcgagcgcctatagatatagcagcacctggtacatgtggcgtggtgcttttgatatctgggccaagggacaatggtcaccgtctcttcagcctccaccaagggcccatcggtcttcccctggcaccctcctccaagagcacctctgggggcacagcggccctgggctgcctggtcaaggactacttccctacatgct

SEQ ID NO: 462819 - DNA, 525 bp, Homo sapiens
  misc_feature: HEFZJCU01CMAY9.49.75.G09.1.454.heavy.3.raw
agtcgagagacacgaccggtgctcgatttagtatagacatcagggaaaggggacccaaaaaccacacccctccttgggagaatcccctagatcacagctcctcaccatggactggacctggagcatccttttcttggtggcagcagcaacaggctcccactcccacttttatttgatgcagtctggggctgaggtgaagaagcctggggcctcagtgaaggtctcctgcacggcctctggtaacacctttaccagtcatggtattatctgggtgcgacaggcccctggacaagggcttgagtggatgggatgggtcagccctttcaatggtgagacaaactatgcacagaaactccagggcagagtcaccatgaccacagacacatccacgaccacagcctacatggagttgaggagcctgagatctgacgacacggccgtttattctgtgcgagagggggggcctaccggaagttttggctggttatctaaggttgtaccgatgggcaggaaccccgtcaccgt

SEQ ID NO: 462820 - DNA, 508 bp, Homo sapiens
  misc_feature: HEFZJCU01DA6ED.12.30.C08.1.454.heavy.3.raw
atacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtggctccatcagcagtggtgattattactggagttggatccgccagtccccagggaagggcctggagtggattgggtacatctatcacagtgggagcacctactacatcccgtccctgaagagtcgaattacgatgtcagtaaacacgtctaggaaccagttctccctgaagctgaggtctgtgactgccgcagacacggccgtctactactgtgccaggtggctttgcgccagtggttcagagatgatcgcttcgattcggtggggccagggaatttcg

SEQ ID NO: 462821 - DNA, 489 bp, Homo sapiens
  misc_feature: HEFZJCU01AXXIN.16.67.G01.1.454.heavy.3.raw
tgtactactccacgaccggtgctcgatttagagtatacatattgggtccctgagactctcctgtgcgacctctggattcacctttagcagctatgccatgagctgggtccgccaggctccagggaaggggctggagtgggtctcaactattagtggtagtggtggtaccacatacttcgctgactccgtgaagggccggttctccatctccagagacacttccaagaacacggtgtatctgcaagtgcacagcctgagagccgaggacacggccatatattactgtgcgaaagatcgattccccctccgtagagatgggctacaaaatctttctccgaattgacttctggggccagggaaccctggtcaccgtctcctcagcctccaccaagggcccatcggtcttccccctggcaccctcctccaagagcacctctgggggcacagcggccctgggctgcctggtcaggactacttccgagtagtaca

SEQ ID NO: 462822 - DNA, 502 bp, Homo sapiens
  misc_feature: HEFZJCU01DO807.48.59.F04.1.454.heavy.3.raw
agtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtcttttgatgcctttgatatgtgggccaagggacaatgtcaccgt

SEQ ID NO: 462823 - DNA, 507 bp, Homo sapiens
  misc_feature: HEFZJCU01C4QN9.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctgggtcatcgtctcctcagcctccaccaagggcccatcggtcttcccctggcaccctcctccaagagcacctctgggggcacagcggccctgggctgcctggtcaaggactacttccgagtagtaca

SEQ ID NO: 462824 - DNA, 507 bp, Homo sapiens; identical to SEQ ID NO: 449199
  misc_feature: HEFZJCU01AUPAF.53.33.C11.1.454.heavy.3.raw

SEQ ID NO: 462825 - DNA, 511 bp, Homo sapiens
  misc_feature: HEFZJCU01EC668.22.82.H05.1.454.heavy.3.raw
acatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgcgttttcttagtggctattttaaaacgtgtccagtgtgaggtgcagctggcggagtctgggggaggcctggtacagccgggggggtccctgagactctcctgtgtagcctccggattcacctttagcagacatggcatgagctgggtccgccaggctccagggaaggggccggagtgggtgtcagtcattagtagtagtggtgatagaatttaccacacagactccgtgaagggccgcttcaccatctctagagacaattcccagaacacactgtatctgcaaatgactaggctgagagccgacgacacggccatttattactgcgcgaaggatatacgggtcgacaacggtggctacgcggttt

SEQ ID NO: 462826 - DNA, 517 bp, Homo sapiens
  misc_feature: HEFZJCU01BDJXL.9.28.C06.1.454.heavy.3.raw
tgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccactaatggagtgggtgtgggctggatccgtcatcccccaggaaaggccctggaatggcttgcattcgtttattggaatgatgataaacgctacagcccatctctgaggaccaggctcaccattacccaaggacacctccaaaaaccaggtggtccttacaatgaccaacatggaccctgtggacacagccacatattactgtgcacacagtgtcatgactgcggtgactgttctcccctttggctactggggccagggaaccctggtcaccgtctcctcagcctccaccaagggcccacg

SEQ ID NO: 462827 - DNA, 499 bp, Homo sapiens; identical to SEQ ID NO: 450129
  misc_feature: HEFZJCU01CC19D.53.14.B03.1.454.heavy.3.raw

SEQ ID NO: 462828 - DNA, 499 bp, Homo sapiens
  misc_feature: HEFZJCU01C4KT3.40.7.A07.1.454.heavy.3.raw
tctagcgactcacgaccggtgctcgatttagcacgtgtcgcaggggaaccacatccctcctcagaagcccccagagcacaactccttaccatggactggacctggaggatcctctttttggtggcagcagccacaggtgtccactcccaggtccagcttgtgcagtctggggctgaggtgaagaagcctggggcctcagtgaaggtttcctgcacggcttctggatacaccttcactagatatgctatacattgggtgcgccaggcccccggacaaagacttgagtggatgggatggatccaccctggcaattataacacaaaacattcacagaagttccagggcagagtcaccattaccagggacacatccgcgagcacagtctacatggagctgagcagcctgagatctgaagacacggctgtgtatactgtgcgacgaatagtggctggcgagaggtgggatactactttgacttctgggggtccagggaacccct

SEQ ID NO: 462829 - DNA, 504 bp, Homo sapiens
  misc_feature: HEFZJCU01CZ3X3.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcaggcggcctttgacttcgtc

SEQ ID NO: 462830 - DNA, 477 bp, Homo sapiens; identical to SEQ ID NO: 444659
  misc_feature: HEFZJCU01EGN8L.16.10.A10.1.454.heavy.3.raw

SEQ ID NO: 462831 - DNA, 507 bp, Homo sapiens; identical to SEQ ID NO: 446095
  misc_feature: HEFZJCU01C1HWD.10.38.D05.1.454.heavy.3.raw

SEQ ID NO: 462832 - DNA, 491 bp, Homo sapiens; identical to SEQ ID NO: 451549
  misc_feature: HEFZJCU01C9YHM.49.17.B06.1.454.heavy.3.raw

SEQ ID NO: 462833 - DNA, 524 bp, Homo sapiens
  misc_feature: HEFZJCU01CEBVU.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctgggctgactggtcaaggactacttcc

SEQ ID NO: 462834 - DNA, 520 bp, Homo sapiens
  misc_feature: HEFZJCU01BKKKV.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccactaggtttgactactggggccagggaagctttggcaccgtctcctcagcct

SEQ ID NO: 462835 - DNA, 428 bp, Homo sapiens
  misc_feature: HEFZJCU01ET4V9.9.34.D01.1.454.heavy.3.raw
tgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcgccctgctccaggagcaccctccgagagcacagcggccctgggctgcctggtcaaggactacttccagacgtatca

SEQ ID NO: 462836 - DNA, 512 bp, Homo sapiens
  misc_feature: HEFZJCU01ARBOT.19.67.G01.1.454.heavy.3.raw
  modified_base (478)..(478): a, c, t, g, unknown or other
tactctcgtgcacgaccggtgctcgatttagagtatacatattggggtttggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttanggcgatggctgggtgacagatcactggggcctac

SEQ ID NO: 462837 - DNA, 488 bp, Homo sapiens
  misc_feature: HEFZJCU01CWYGX.19.53.E09.1.454.heavy.3.raw
tactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaatagaacagtctgagagctgaggacacggccttgtattactgtgcaaggaggt

SEQ ID NO: 462838 - DNA, 427 bp, Homo sapiens; identical to SEQ ID NO: 452886
  misc_feature: HEFZJCU01DEO08.4.37.D04.1.454.heavy.3.raw

SEQ ID NO: 462839 - DNA, 436 bp, Homo sapiens
  misc_feature: HEFZJCU01DSDP4.40.86.H09.1.454.heavy.3.raw
tctagcgactcacgaccggtgctcgatttagtgctatagacttgggtttggggtgtctctagcaacaatgctgcttggaattggatcaggcagtccccatcgaggggccttgagtggctggggaggacatactacaggtccacgtggaaaaacgattatgcagcatctgtgaaaagtcgaataaccatcgacccagacacatccaagaaccagttctccctgcaactgaactctctgactcccgaagacacggctgtctattactgtgcatatggttcggggagttatccctattggggccagggaaccctggtcaccgtctcctcagcctccaccaagggcccatcggtcttccccctggcgccctgctccaggagcacctccgagagcacagcggccctgggctgcctggtcaaggactactccagtcgctaga

SEQ ID NO: 462840 - DNA, 504 bp, Homo sapiens
  misc_feature: HEFZJCU01CCTII.49.31.C09.1.454.heavy.3.raw
agtcgagagacacgaccggtgctcgatttagacgtctcatcaaggaaggaagggacctcaggggtccgggagatcatgagggtgtccctgggactctcctgtgcagcctctggattcactttcagcagctatggcatgaactgggtccgccaggctccagaaaaggggctggagtgggtctcaggtattagtggtagtggtggtatcacatcctacgtagactccgtgaagggccggttcaccatctccagagacaattccaagaacaaactttatttgcacatggaaagcctgagagccgaggacacggccatatattactgtgcgagacgtgggaactacttaggaggtgcttttgatgtctggggccaagggacaatggtcaccgtctcttcagcctccaccaaggcccatcggtcttcccctggcaccctcctccaagagcacctctgggggcacagcggccctgggctgcctggtcaaggactacttcctctctcgact

SEQ ID NO: 462841 - DNA, 438 bp, Homo sapiens
  misc_feature: HEFZJCU01EUTMC.3.21.B10.1.454.heavy.3.raw
agacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgtttattactgtgcaagagcgaggaggagcagttttgacagctggggccagggaaccctggtcaccgtctcctcagcctccaccaagggcccatcggtcttccccctggcgccctgctcccaggagcacctccgagagcacagcggccctgggctgcctggtcaaggactacttccgagtgcgtct

SEQ ID NO: 462842 - DNA, 510 bp, Homo sapiens; identical to SEQ ID NO: 447226
  misc_feature: HEFZJCU01EDACO.12.78.H01.1.454.heavy.3.raw

SEQ ID NO: 462843 - DNA, 509 bp, Homo sapiens
  misc_feature: HEFZJCU01AEVAI.51.40.D07.1.454.heavy.3.raw
cgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtctgggggaggcgtggtccagcctgggaggtccctgagactctcctgtgtagtctctggattcaccttcagggtgtacgacatgcactgggtccgccaggctccaggcaaggggctggagtgggtggcatttatatcacatgatggaagtaaaacatactatgcagagtccgtgaagggccgattcaccatctccagagacaattccaagaacacactgtttctgcacatgaaaagcctgagagctgaggacacggctgtttattactgtgcgaacttaatcacggagacaacggtacccccg

SEQ ID NO: 462844 - DNA, 483 bp, Homo sapiens; identical to SEQ ID NO: 444924
  misc_feature: HEFZJCU01DSRSA.10.35.D02.1.454.heavy.3.raw

SEQ ID NO: 462845 - DNA, 510 bp, Homo sapiens
  misc_feature: HEFZJCU01B2LNY.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtgccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctcattccgttcatctgaatactggggccagggaacccctggtcgccg

SEQ ID NO: 462846 - DNA, 506 bp, Homo sapiens
  misc_feature: HEFZJCU01EJT7T.9.78.H01.1.454.heavy.3.raw
tgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtctcccctgcgccctgctccaggagcacctccgagagcacagcggccctgggctgcctggtcaaggactacttccagacgtatca

SEQ ID NO: 462847 - DNA, 522 bp, Homo sapiens
  misc_feature: HEFZJCU01C7DKZ.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtcttcccctgcgccctgctcagagcacctccgagagcacagcgccctgggcg

SEQ ID NO: 462848 - DNA, 534 bp, Homo sapiens
  misc_feature: HEFZJCU01D5V2U.48.40.D07.1.454.heavy.3.raw
  modified_base (497)..(497): a, c, t, g, unknown or other
agtatacatacacgaccggtgctcgatttagtgatagagcgtaacaacagagggggagccccagacctgggattcccagctgtttctgcttgctgatcaggaccgcacacagagagctcaccatggagttggggctgacctgggttttccttgtggctactttaagaggtgtcctgtgtgaggtgcacctgctggagtccgggggaggcttagttcggccgggggagtccctgagactcgcctgtgtagtgtctggattcaccttcaggaattacgacatggactgggtccgccaagctccagggaaggggctggagtgggtctcaaacgtgaacgttgatggcgggatcacaaaatacgcggactccgtgaaaggccgcttcaccgtctccagagacaacggcgagaatactctgtatttgcagatgagaaatctgagaggcgaggacaccggcgctttatattgtacaacgtcgttttactttctaatggtgctnttacgaacgacatgactattggggtcgggaacctggt

SEQ ID NO: 462849 - DNA, 506 bp, Homo sapiens
  misc_feature: HEFZJCU01B8DNM.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttcccctggcaccctcctccaagagcacctctgggggcacgagcggccctgggctgcctggtcaaggactacttcctacgtcgtat

SEQ ID NO: 462850 - DNA, 518 bp, Homo sapiens
  misc_feature: HEFZJCU01CA0FC.48.26.C04.1.454.heavy.3.raw
agtatacatacacgaccggtgctcgatttagtctagcgactttgggtttggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagaaggggttttactatgggttcggggagtctccggaccctagcaactgggttccgacccc

SEQ ID NO: 462851 - DNA, 492 bp, Homo sapiens
  misc_feature: HEFZJCU01E0GNN.12.75.G09.1.454.heavy.3.raw
atacgacgtacacgaccggtgctcgatttagtatagacatcaggggccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattaccgcggacgaatccacgaccacagcctacatagagctgcgcagcctgagatctgaagacacggccatttattactgtgcgagagatgcagggccctcccacatcggttatttctttgactcgtggggccgagggaccctggtcaccgtctcctcg

SEQ ID NO: 462852 - DNA, 430 bp, Homo sapiens
  misc_feature: HEFZJCU01ANNU5.2.38.D05.1.454.heavy.3.raw
acgctcgacacacgaccggtgctcgatttagtatctgatagttgggtttgggatacaactttaccatctactggatcgcctgggtgcgccagatgcccgggaaaggcctagagtgggtgggaatcgtctatcctgacgactctgataccagatacagcccgtccttccaaggccaggtcaccatctcagccgacaagtccgtcaataccgcctacctgcagtggagcagtctgcaggcctcggacaccgccatgtacttctgtgcgagagggttcggggatgactactggggccagggaaccctggtcaccgtctcttcagcttccaccaagggcccatcggtcttccccctggcgccctgctccaggagcacctctgggggcacagcggccctgggctgcctggtcaaggactacttccagtcgctaga

SEQ ID NO: 462853 - DNA, 496 bp, Homo sapiens
  misc_feature: HEFZJCU01DH0NL.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtgggtgggtcagcggcttgacggtaaggcacagtatgcaccgaagatgaagggcagagtcacgattaccacggacaccccacgaacacagtctacatgcaactgacgagcctgagagctgacgacacggccgtctattactgtgcgagaatgttttctgtcatcgtacaatttgataggctctatggactggctctc

SEQ ID NO: 462854 - DNA, 492 bp, Homo sapiens; identical to SEQ ID NO: 448024
  misc_feature: HEFZJCU01EAJVN.19.53.E09.1.454.heavy.3.raw

SEQ ID NO: 462855 - DNA, 510 bp, Homo sapiens
  misc_feature: HEFZJCU01BXQXE.4.26.C04.1.454.heavy.3.raw
agcactgtagcacgaccggtgctcgatttagtctagcgactttgggtttggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagttggtggagtctgggggaggcttggtacagcctggggggtccctgagactctcctgtacagactctggattcacctttagcagccatgccatgagctgggtccgccaggctccagggaagggctggagtgggtctcagcaattagtggaggtggtggtggtggtacatactacgcaaactccgtgagggccgattcaccatctccagagacaattccaagaacacgttatatctgcaaatgaacagcctgcgagccgacgacacggccgtatattactgtgcgaaatgacctttattgcgacgagcgtagca

SEQ ID NO: 462856 - DNA, 501 bp, Homo sapiens
  misc_feature: HEFZJCU01B6F8I.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtctggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgaggctgtgagcgccgcagacacggccgtgtattactgtgcgagactggccgcaacagactacggtggcgaactcctatgcttttgatatctggggccaagggact

SEQ ID NO: 462857 - DNA, 500 bp, Homo sapiens
  misc_feature: HEFZJCU01DRTFU.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgctttgatatctggggccaaggggac

SEQ ID NO: 462858 - DNA, 524 bp, Homo sapiens; identical to SEQ ID NO: 446401
  misc_feature: HEFZJCU01DE2AF.3.82.H05.1.454.heavy.3.raw

SEQ ID NO: 462859 - DNA, 520 bp, Homo sapiens
  misc_feature: HEFZJCU01DLWDB.53.57.F02.1.454.heavy.3.raw
cgcgtatacacacgaccggtgctcgatttagctcgatatagttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctggattcaccttcagggtctatgacatgcactgggtccgccaggctccaggcaaggggctggagtgggtggcagttatatcaaatgatggaagtaagaaatactatgtagactccgtgaagggccgattcaccatctccagagacaattccaagaatacgctgtatctgcacatgaacagcctgagagccgaagacacgggtgttattactgtgcgaacttaattacggaggacaacggtaaccccgtcgcacgtacggtacg

SEQ ID NO: 462860 - DNA, 515 bp, Homo sapiens
  misc_feature: HEFZJCU01DGOR7.51.5.A05.1.454.heavy.3.raw
cgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagagtgagttctccctgaggctgacgtctttaagtgtcgctgatacgggtgtctatttctgtgcgagactgcccggtcctgcacctcgtgtggccccaatttggtttaccggcacacaaaatcaagggcaagtcctacgacggtctggtacg

SEQ ID NO: 462861 - DNA, 529 bp, Homo sapiens
  misc_feature: HEFZJCU01BD68O.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccaggtcaccgtctcctcagcctccaccaaggcccatccgtcttcccctcggcgccctcgctccaggagcaccctccgacgagcgacacgcggcccgtcgggcgtgcctggtcaaggactacttcctacg

SEQ ID NO: 462862 - DNA, 394 bp, Homo sapiens; identical to SEQ ID NO: 444701
  misc_feature: HEFZJCU01B7MZC.3.12.B01.1.454.heavy.3.raw

SEQ ID NO: 462863 - DNA, 541 bp, Homo sapiens
  misc_feature: HEFZJCU01CMIXS.48.43.D10.1.454.heavy.3.raw
agtatacatacacgaccggtgctcgatttagactagcagtaagggggtgctttctgagagtcatggacctcctgcacaagaacatgaaacacctgtggttcttcctcctcctggtggcagctcccagatgggtcctgtcccaggtacagctacaacagtggggcgcaggacatttgaagccttcggagacgctgtccctcacctgcgctgtgtatggtgggtccttcaggggttacttctggacctggatccgccagcccccagggaaggggctcggagtggattggggaggtcaggcatagtgccagggccacttacaacccgtccctcaacgatcgagtctccatcttagttgacacgtccaagaaccagttctcccttcaactcacgtctgtgaccgccgcggacacggctatatactactgtgcgagagggtccctggctctctccgcctttgacgcctggggccgagggaaaactggtcaccgtctcctcagcttccaccaagggcccatcggtcttccccctcggccgcccgtcg

SEQ ID NO: 462864 - DNA, 501 bp, Homo sapiens; identical to SEQ ID NO: 445341
  misc_feature: HEFZJCU01C9FUX.48.34.D01.1.454.heavy.3.raw

SEQ ID NO: 462865 - DNA, 526 bp, Homo sapiens
  misc_feature: HEFZJCU01B64FW.52.5.A05.1.454.heavy.3.raw
cgcagtacgacacgaccggtgctcgatttagatagatagacagggggctctgggaaaggagccccagccctgagattcccaggtgtttccattcggtgatcagcactgaacacagaactcaccatggagtttggactgagctgggttttccttgttgctattttaaaaggtgtccaggctgaagtgcagctggtggaatctgggggaatcgtggtgcggcctggggggtccctgagactctcctgttcagccgctggattcacgtttgatgattatgccatgtactgggtccgtcaagctccggggaagggtctggagtgggtctctcttgtgaattgggatggcagtgcttcttattacgccgactctgtgaagggtcggttcaccatctccagagacaacagaaaaactccctatatcttcaatgagaagtctgagattgaggacaccgccttatattactgcgctaaaggccttgacgcgttggctataaatggattggaccactggggccagggaaccctac

SEQ ID NO: 462866 - DNA, 528 bp, Homo sapiens
  misc_feature: HEFZJCU01B2ES8.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatccctgaaagcgtcaactactactactacggtatggacctc

SEQ ID NO: 462867 - DNA, 476 bp, Homo sapiens; identical to SEQ ID NO: 445154
  misc_feature: HEFZJCU01CEVY2.16.10.A10.1.454.heavy.3.raw

SEQ ID NO: 462868 - DNA, 509 bp, Homo sapiens
  misc_feature: HEFZJCU01DCTN3.12.55.E11.1.454.heavy.3.raw
  modified_base (447)..(447): a, c, t, g, unknown or other
  modified_base (502)..(502): a, c, t, g, unknown or other
atacgacgtacacgaccggtgctcgatttagcactcgcacgttgggtttgggctgagctgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactaacggtgaccttttctggtatttcgatctctggggccgtggcaccctggtcnctgtctcctcggcttccaccaaggcccatcggtctccccgtgcgccctgctcagngcactcg

SEQ ID NO: 462869 - DNA, 507 bp, Homo sapiens
  misc_feature: HEFZJCU01CVZUF.49.20.B09.1.454.heavy.3.raw
agtcgagagacacgaccggtgctcgatttagtgtagtgtgaaggggacccaacaaccacatccctcctcagaagcccccagagcacaacgcctcaccatggactggacctggaggatcctctttttggtggcagcagccacaggtgcccactcccaggtccagcttgtgcagtctggggctgagttgaagaagcctggggcctcagtgagggtttcctgcgtggtctccggatacaccttcactagtcatcctatgcattgggtgcgccaggcccccggacaaaggtttgagtggatgggatggatcaccgctggcaatggtgacacaaaatattcagagaagttccagggcagagtctccattaccagggacacagctgcgagtacagggtacatggaactgagtggcctgagatctgaggacacggctgtttattactgtgcgagagggaagtgggatattgtggcagctccaggtgcccagccgggcccctactttgactactc

SEQ ID NO: 462870 - DNA, 486 bp, Homo sapiens
  misc_feature: HEFZJCU01B407U.47.85.H08.1.454.heavy.3.raw
agctcacgtacacgaccggtgctcgatttagtatcactcagtcggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctccgagagcacagcggccctgggctgcctggtcaggactacttcctacgtgagct

SEQ ID NO: 462871 - DNA, 519 bp, Homo sapiens
  misc_feature: HEFZJCU01EH3ZO.47.55.E11.1.454.heavy.3.raw
agctcacgtacacgaccggtgctcgatttagcactcgcacgttgggtttgggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataattatgcggactccgtgaggggccgattcagcatctccagagacaacggcaagagtatactgtatctggaaatgaacaatctgagagtcgacgatacggctgtctatcattgtgttttcgattgcctttccgggtccgcgggactttctgggggtccagggtaacccg

SEQ ID NO: 462872 - DNA, 501 bp, Homo sapiens
  misc_feature: HEFZJCU01DJFQE.9.30.C08.1.454.heavy.3.raw
tgatacgtctcacgaccggtgctcgatttagtctgacgtcaaagggaaagggtctgtgaagccttcacagaccctgtccctcacctgcactgtctctggtgactccatcaccggtactaattactactggagttggatccgccagcccccccgggaagggcctggagtggattggatacgccttttacagtggagtcacctactacaacccgtccctcaagagccgagttaccatatctgtcgacacgtcccagaatcagttctccctggaggtgacctctgtgactgccgcagactcggccgtgtatttctgtgccagaacgcaaagcagcgcctactatactttaaactttgacttctggggccagggatccctggtcaccgtctcctcagcctccaccaagggcccatcggtcttcccctggcgccctgctccaggagcacctccgagagcacagcggccctgggctgcctggtcaaggactacttccagacgtatca

SEQ ID NO: 462873 - DNA, 509 bp, Homo sapiens; identical to SEQ ID NO: 444586
  misc_feature: HEFZJCU01CB7WJ.12.78.H01.1.454.heavy.3.raw

SEQ ID NO: 462874 - DNA, 507 bp, Homo sapiens
  misc_feature: HEFZJCU01CNO0A.48.81.H04.1.454.heavy.3.raw
agtatacatacacgaccggtgctcgatttagtagtgtagattcgcgggcacgaccggtgctcgatttagatagctctcgttgggactgagctggattttccttttggctattttaaaagctgtccagtgtgaagtgcacctggtggagtctgggggaggcttggtacagcctggcaggtccctgagactctcctgtgcagcctctggattcacctttgatgattatgccatgcactgggtccggcaagttccagggaagggcctggagtgggtctcaggcattagtagaattaggggtagcatagcctatgcggattctgtgaagggccgattcaccatctccagagacaacgccaagaactccctgtatctgcaaatgaacagtctgagacctgaggacacggccttctattactgtgcaaaagatcaggcattagactacaacggtatggacgtctggggccaagggatcacggtcaccgtctcctcagcctccaccaagggccc

SEQ ID NO: 462875 - DNA, 543 bp, Homo sapiens
  misc_feature: HEFZJCU01AR1QP.13.57.F02.1.454.heavy.3.raw
tcacgtactacacgaccggtgctcgatttagctcgatatagttgggtttggggtgggaaatactttctgagactcatggacctcctgcacaagaacatgaaacacctgtggttcttcctcctcctggtggcagctcccagctgggtcctgtcccaggtgcagctgcaggagtcgggcccaggactggtgaagccttcggggaccctgtccctaaattgcgctgtctctggtgactccatcagcggtagtaaatggtggagttgggtccgccagcccccagggaaggggctggagtggattggggaaatctttcatagcgggatcaccaactacaacccgtccctcaagagtcgagtcaccatatctatagacaagtccaagaaccacttctccctgaacgtgagttctgtgaccgccgcggacacggccgtgtattactgtgcgagaggattgtggttttactctggttcaatgagttattatgtcttttgactattggggccagggaaccctggtcaccgtctcctcagcctccaccaaggg

SEQ ID NO: 462876 - DNA, 507 bp, Homo sapiens
  misc_feature: HEFZJCU01DL2U4.10.38.D05.1.454.heavy.3.raw
  modified_base (342)..(342): a, c, t, g, unknown or other
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctgggagtgggtctcagttattgaaacngatgggcactacatattattctgactccgtgaagggccgttcaccctctccagagacacttccaacaacatcttgtatcttcacatgcacaatctgagagtcgacgacacggccacctattattgtgcgcgacatgactacgctcaattctggggccaggggacg

SEQ ID NO: 462877 - DNA, 509 bp, Homo sapiens
  misc_feature: HEFZJCU01CUB51.52.24.C02.1.454.heavy.3.raw
cgcagtacgacacgaccggtgctcgatttagtacagatcgttagggaaaggggctgggagacgagcccagcactggaaggcgccggtgtttccattcggtgatcagcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtacaccctctggattcaccttcagcaactatgcaatgcactgggtccgcctggctcccggcaagggtctggactgggtggcaggtatatcagatgatgggaccaaaaatactacgcaaactccgtgaagggccgattcaccgtatctagagacagttccgatgacacaatctatctgcaaatgaacagcctgaagttgacgacacgggtcttttttactgttgcgcctgggagcagtggctggccacatgatgcttttg

SEQ ID NO: 462878 - DNA, 425 bp, Homo sapiens; identical to SEQ ID NO: 445744
  misc_feature: HEFZJCU01DP7DB.16.53.E09.1.454.heavy.3.raw

SEQ ID NO: 462879 - DNA, 483 bp, Homo sapiens
  misc_feature: HEFZJCU01BWIF7.47.59.F04.1.454.heavy.3.raw
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggcccatcggtcttcccctggcgccctgctccaggagcacctccgagagcacagcggccctggggctgcctggtcaaggactacttcctacgtgagct

SEQ ID NO: 462880 - DNA, 496 bp, Homo sapiens
  misc_feature: HEFZJCU01BABG2.51.38.D05.1.454.heavy.3.raw
cgatcgtatacacgaccggtgctcgatttagtatctgatagttgggtttggggtctgggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggcttctttttactgttgcgccaggaagcagtggctgg

SEQ ID NO: 462881 - DNA, 515 bp, Homo sapiens
  misc_feature: HEFZJCU01EJXQW.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctggtggacagatcacgtggggccaac

SEQ ID NO: 462882 - DNA, 519 bp, Homo sapiens
  misc_feature: HEFZJCU01A2T8J.10.30.C08.1.454.heavy.3.raw
catagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatctgggggagccttggtacagcctggcgggtccctgagactctcctgtacagtctctggattcacctctgatgattatgccatgcactgggtccggcaagctccagggaagggcctggagtgggtctctggaatcacttacaatagtgatttccttaaatatgcggactctgtgagggggcgtttcaccatctccagagacaacgccaggaactccctctatctacaaatgaacagtctgagacctgaggacacggccttatatttctgtgcaaaagatcttggagctggccgtgaccactggggccagggaccct

SEQ ID NO: 462883 - DNA, 498 bp, Homo sapiens
  misc_feature: HEFZJCU01EYIP6.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagaggagctatatctggaaccccga

SEQ ID NO: 462884 - DNA, 519 bp, Homo sapiens; identical to SEQ ID NO: 448820
  misc_feature: HEFZJCU01BTC2G.2.11.A11.1.454.heavy.3.raw

SEQ ID NO: 462885 - DNA, 523 bp, Homo sapiens
  misc_feature: HEFZJCU01CTIHU.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttggttctggggccagggggaccctggtcatcgtctccccagcctccaccaagggcccatcggtcttcccctggcg

SEQ ID NO: 462886 - DNA, 482 bp, Homo sapiens
  misc_feature: HEFZJCU01EYIU6.40.83.H06.1.454.heavy.3.raw
tctagcgactcacgaccggtgctcgatttagatcacgtgcgtcgcgggtctgggagaggagcccagcactcgaagtcggcggtgttgccattcggtgatcagcactgaacacagaggactcaccatggagtttgggctgagctgggttttcctcgttgctcttttaagaggtgtccagtgtcaggtgcagttggtggagtctgggggaggcgtggtccagcctgggaggtcactgagactctcctgtgcatcgtccggattcaccttccataaatataacatgcactgggtccgccaggctccaggcaagggactgcagtggctggccactgtctggtcggatgaaagttatgcatactatgcagactctctgaggggccgattcatcatctctagagacaattcgaagaacacggcttatctgcaaatgaacagcctgacagtcgaggacacggctgtatatttctgtgcgaatgaggtaa

SEQ ID NO: 462887 - DNA, 396 bp, Homo sapiens; identical to SEQ ID NO: 444469
  misc_feature: HEFZJCU01DT4R1.47.46.E02.1.454.heavy.3.raw

SEQ ID NO: 462888 - DNA, 500 bp, Homo sapiens; identical to SEQ ID NO: 444529
  misc_feature: HEFZJCU01EL84S.12.38.D05.1.454.heavy.3.raw

SEQ ID NO: 462889 - DNA, 494 bp, Homo sapiens
  misc_feature: HEFZJCU01DWL0W.10.21.B10.1.454.heavy.3.raw
catagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagccagagagccgaggacacgggtgtttattactgtgggagaaatcctagtggc

SEQ ID NO: 462890 - DNA, 500 bp, Homo sapiens
  misc_feature: HEFZJCU01B43R3.51.43.D10.1.454.heavy.3.raw
cgatcgtatacacgaccggtgctcgatttagactagcagtaagggggagcatcacccagcaaccacatctgtcctctagagaatcccctgagagctccgttcctcaccatggactggacctggaggatcctcttcttggtggcagcagccacaggagcccactcccaggtgcagctggtgcagtccggggtgaagtgaagaagcctggggcctcagtgaaggtctcctgcagggcctctggatacaccttcaccggctattatatccactgggtgcgacaggcccctggacaagggcttgagtggatgggatggatgaagcccaatagtggtgccacaaagacagcacagaagtttcagggcagggtcaccatgaccagggagacgtccgtcaggacagcctatatggaggtgaccagcctgagccctggacgacacggccatatattttctgtgtcgcgaggaattcgacttctggaataattacttggttggaactac

SEQ ID NO: 462891 - DNA, 486 bp, Homo sapiens
  misc_feature: HEFZJCU01BHQWM.12.53.E09.1.454.heavy.3.raw
atacgacgtacacgaccggtgctcgatttagagagagtgtgttgggtttggggggtccctgagactctcctgtgcagcctctcgattcagcttcagtaactatgctatgcactgggtccgccaggctccaggcagggggctggagtgggtggcagttatatcatatgatggaagacataaatactacgcagactccgtgaagggccgattcaccctctccagagacaattccaagaatacgctgtatatgcaaatgaacagcctgagacctgaggacacggctatgtattactgtgcgagaggaccattttggaatgcttattataccggaaacgcttttgatatttggggccaagggacaatggtcaccgtctcttcagcctccaccaagggcccatcggtcttcccctggcaccctcctccaagagcacctctgggggcacagcggccctgggctgcctggtcaaggctactcctacgtcgtat

SEQ ID NO: 462892 - DNA, 520 bp, Homo sapiens
  misc_feature: HEFZJCU01AJYQO.53.10.A10.1.454.heavy.3.raw
cgcgtatacacacgaccggtgctcgatttagcgtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgccctccaggggggacctttggggtttcgaccccttggggccagggaaccctggtcaccgtctcctcagcctccaccaagggcccatcggtcttcccctggcaccctcctccaagagcacctctgggggc

SEQ ID NO: 462893 - DNA, 504 bp, Homo sapiens
  misc_feature: HEFZJCU01C20LY.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactaggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtagcgagaattgttttctgtcatcgtacaatttgataggctctatggactggacttcgt

SEQ ID NO: 462894 - DNA, 509 bp, Homo sapiens
  misc_feature: HEFZJCU01EYYR8.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactgggcgattatacatattatacagactccgtgaagggccgcttcaccatcctccagagacaattccaagaacacggtgtatctgcaaatgaacagcctgagagccgaggacacggccacatattactgtgcgaagatctcgggctggttccgcggtccgggt

SEQ ID NO: 462895 - DNA, 537 bp, Homo sapiens
  misc_feature: HEFZJCU01CRHQG.17.28.C06.1.454.heavy.3.raw
  modified_base (349)..(349): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctggggggtccctgagactctcctgtgcagcctccggattccccttcagtagttattggatgacttgggtccgccagactccagggaaggggctggagtgggtggccaacataaagcaagntggaactgccgagttttacgtggactctgtgaagggccgtttcaccatctccagagacaacgccaagaattcactgtatctacaactgaacagcctgagagtcgcagacacggccgtgtattactgtgcgagatgtaggaaaaagtatggctgtgtttattggggccagggagcccctggtcctaccg

SEQ ID NO: 462896 - DNA, 514 bp, Homo sapiens
  misc_feature: HEFZJCU01DI796.12.1.A01.1.454.heavy.3.raw
atacgacgtacacgaccggtgctcgatttagacgtctcatcagggggggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagtagtagttattactactggggctggatccgccagcccccaggggaggggctgaagtggattgggagtgtctattatagtgggatcacctactacaacccgtcctcaagagtcgagtcaccatatccgtcgacacgtccaagaaccagttctccctgaagctgagctctgtgaccgccgcagacacggctgtgtattactgtgcgagacagccaagacagtattttggagttggttactgttggacttactttgactacgtggggccaggggaaccctggt

SEQ ID NO: 462897 - DNA, 495 bp, Homo sapiens; identical to SEQ ID NO: 451022
  misc_feature: HEFZJCU01C9731.16.37.D04.1.454.heavy.3.raw

SEQ ID NO: 462898 - DNA, 517 bp, Homo sapiens
  misc_feature: HEFZJCU01B0SP3.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaagggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtgtcatagacctaggatacaacgacggtggtacctggtattc

SEQ ID NO: 462899 - DNA, 536 bp, Homo sapiens
  misc_feature: HEFZJCU01E2AVQ.2.81.H04.1.454.heavy.3.raw
acgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctggtggagtccgggggaggctgggtccagcctggggggtccctgagactctcctgttcagcctctggattcacctttagtaggttttggatgagttgggtccgccaggctccagggaaggggctggagtgggtggccaacatagagtacgatggaagtgagaaaactatgtggactccgtgaagggccgattcaccatctccagagacaacgacaagaatttagtgtatctgcaaatagagcagcctgagaggccgacgggaacgacggacgtgttgttagttatttagttgtcggag

SEQ ID NO: 462900 - DNA, 527 bp, Homo sapiens
  misc_feature: HEFZJCU01EW7A1.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctcccttgacttctggggccatggaaccccggtc

SEQ ID NO: 462901 - DNA, 492 bp, Homo sapiens
  misc_feature: HEFZJCU01EY4U3.11.38.D05.1.454.heavy.3.raw
cgagagataccacgaccggtgctcgatttagtatctgatagttgggtttgggggaggcttggtacagcctggggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagtggtggtagctgctactggggccagggaaccctggtcaccgtctcctcagcctccaccaagggcccatcggtccttcccctggcaccctcctccaagagcacctcgtgggggcacagcggccctgggctgcctggtcaaggactacttcgtatctctcg

SEQ ID NO: 462902 - DNA, 505 bp, Homo sapiens
  misc_feature: HEFZJCU01B48XN.40.81.H04.1.454.heavy.3.raw
tctagcgactcacgaccggtgctcgatttagtagtgtagattcgcggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcgggactgacctctcggaccgactacgggccaatgtattactgtggaagagacgttggtggctccgcggggctgaccactggggccg

SEQ ID NO: 462903 - DNA, 503 bp, Homo sapiens
  misc_feature: HEFZJCU01CCX65.13.87.H10.1.454.heavy.3.raw
tcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaatgaacagcctgagagctgaggacacggccttgtattattgtgcaaagataccaaccccttacgtacg

SEQ ID NO: 462904 - DNA, 530 bp, Homo sapiens
  misc_feature: HEFZJCU01C5Y3J.53.64.F09.1.454.heavy.3.raw
  modified_base (472)..(472): a, c, t, g, unknown or other
cgcgtatacacacgaccggtgctcgatttagcgcgtatacaaggggagctctgagagaggagcccagccctgggattttcaggtgttttcatgtggtgatcgggactgaacagagagaactcaccatggagtctgggctgacgtggctttttcttgtggctattttaaaaggtgtccagtgcgacgtgcagctggtggagtcggggggaggcttggtacagccgggggggtccctgagactctcctgtagagtctctggcttcacctttagagtctatgacatgagttgggtccgccaggctccggggaaggggctggagtgggtctcaacgatcagtgatagcggaagtaccacaaactacgccgcctccgtgaagggccgatgcaccgtctccagagacaattcgaaggacactttatatctgcaactcaacagactgacaaccgctgacacggccgtctattactggtntcaaagaagacggaccgctggacgaggagccagaggaaaatcactactttgactacgg

SEQ ID NO: 462905 - DNA, 499 bp, Homo sapiens
  misc_feature: HEFZJCU01B599H.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctgggggtggctacgagtactggtacttcgatctctgggccgtggcaccctgctgactgtctcctcagcctccaccaagggcccatcggtcttcccctggcgccctgctccaggacgcacctccgagagcacagcggccctgggctgcctggtcaaggactaccg

SEQ ID NO: 462906 - DNA, 528 bp, Homo sapiens
  misc_feature: HEFZJCU01BDWWT.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcctttttacaccttcccttgacttctggggccatggaaccccggt

SEQ ID NO: 462907 - DNA, 527 bp, Homo sapiens
  misc_feature: HEFZJCU01BGAZR.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttactgacccctggggccgggaaccctggtcaccgtctccccaccctccaccg

SEQ ID NO: 462908 - DNA, 467 bp, Homo sapiens; identical to SEQ ID NO: 448623
  misc_feature: HEFZJCU01DNZCH.48.59.F04.1.454.heavy.3.raw

SEQ ID NO: 462909 - DNA, 494 bp, Homo sapiens
  misc_feature: HEFZJCU01CJR3L.10.29.C07.1.454.heavy.3.raw
catagtagtgcacgaccggtgctcgatttagagtgctacgaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccccgagactctcctgtgcagcctctggaatccccttcagtacctatggcatgcactgggtccgccaggctccaggcaaggggctggagtgggtggcagccatatcgtatgatgtaactaataaatactatgcagactccgtgaagggccgattcaccatctccagagacaatttcaagaacacgctgtttctgcaaatgaacagcctgagagctgaggacacggctgtgtattactgtgcgaaagatatcgcggtgacta

SEQ ID NO: 462910 - DNA, 501 bp, Homo sapiens
  misc_feature: HEFZJCU01EY322.48.9.A09.1.454.heavy.3.raw
agtatacatacacgaccggtgctcgatttagcgagacgcgcagggggctttctgagagtcatggatctcatgtgcagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtctttttgatgtcctttgatatgtgggccgaagggacaatggtcaccgtctt

SEQ ID NO: 462911 - DNA, 502 bp, Homo sapiens
  misc_feature: HEFZJCU01DXZMQ.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagattgttttctgtcatcgtactaattgaatggctctatgactggtacttcgtc

SEQ ID NO: 462912 - DNA, 504 bp, Homo sapiens; identical to SEQ ID NO: 445932
  misc_feature: HEFZJCU01A0CZY.17.25.C03.1.454.heavy.3.raw

SEQ ID NO: 462913 - DNA, 536 bp, Homo sapiens
  misc_feature: HEFZJCU01EOK4L.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtattttgtgtgaaagatacgaagtctatgatacccaatttgggagggcctttcatgtctggggccaaggacgctggtcaccgtctcttcagcctccaccaagggcccatcggtcttccccctggccaccctcctccaagagcacctctgggggcacagcc

SEQ ID NO: 462914 - DNA, 502 bp, Homo sapiens
  misc_feature: HEFZJCU01D08SC.13.33.C11.1.454.heavy.3.raw
tcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctgggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaataagaattgcaaacgatgcttttgatatgtgggccagggacacg

SEQ ID NO: 462915 - DNA, 531 bp, Homo sapiens
  misc_feature: HEFZJCU01BRRJN.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactacgtgggggttcgaccccgtgggggccaggggaaccctggtcaccggtctcctcagcctccaccg

SEQ ID NO: 462916 - DNA, 521 bp, Homo sapiens; identical to SEQ ID NO: 445317
  misc_feature: HEFZJCU01BEBLW.12.40.D07.1.454.heavy.3.raw

SEQ ID NO: 462917 - DNA, 509 bp, Homo sapiens; identical to SEQ ID NO: 446247
  misc_feature: HEFZJCU01DIKAS.51.43.D10.1.454.heavy.3.raw

SEQ ID NO: 462918 - DNA, 501 bp, Homo sapiens
  misc_feature: HEFZJCU01DZ54U.10.34.D01.1.454.heavy.3.raw
catagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagcctggggggtcccttagactctcctgtgcagcctctggattcactttcagtaacgcctggatgaactgggtccgccaggctccagggaagggctggagtgggttggccatattaaaatcaaagctgatggtgggacaacagagcacgctgcacccgtgaaaggcagattcagcatctcaagagatgattacaaaaagtacgctgtatctgaacatgaacagcctagaaaacggaaggacacagccgtgtattactgtgccactcaggaccgatattgtt

SEQ ID NO: 462919 - DNA, 532 bp, Homo sapiens; identical to SEQ ID NO: 445228
  misc_feature: HEFZJCU01CL2W6.7.78.H01.1.454.heavy.3.raw

SEQ ID NO: 462920 - DNA, 478 bp, Homo sapiens
  misc_feature: HEFZJCU01EXAML.40.83.H06.1.454.heavy.3.raw
tctagcgactcacgaccggtgctcgatttagatcacgtgcgtcgcgggggggagaggagcccagcactcgaagtcggcggtgttgccattcggtgatcagcactgaacacagaggactcaccatggagtttgggctgagctgggttttcctcgttgctcttttaagaggtgtccagtgtcaggtgcagttggtggagtctgggggaggcgtggtccagcctgggaggtcactgagactctcctgtgcatcgtccggattcaccttccataaatataacatgcactgggtccgccaggctccaggcaagggactgcagtggctggccactgtctggtcggatgaaagttatgcatactatgcagactctctgaggggccgattcatcatctctagagacaattcgaagaacacggcttatctgcaaatgaacagcctgacagtcgaggacacggctgtatattctgtgcgaatgaggaa

SEQ ID NO: 462921 - DNA, 527 bp, Homo sapiens; identical to SEQ ID NO: 446200
  misc_feature: HEFZJCU01BRY18.7.70.G04.1.454.heavy.3.raw

SEQ ID NO: 462922 - DNA, 491 bp, Homo sapiens
  misc_feature: HEFZJCU01DPWKA.10.1.A01.1.454.heavy.3.raw
  modified_base (472)..(472): a, c, t, g, unknown or other
catagtagtgcacgaccggtgctcgatttagacgtctcatcaggggctgggagaggagcccagcactagaagtcggcggtgtttccattcggtgatcagcactgaacacagaggactcaccatggagtttgggctgagcgtggttttccgtcgttaggctcttttaagaggtgtccagtgtcaagtgcagctggcggagtctgggggaggcgtggtccagcctgggaggtccctgagactctcctgtgcagcctctgggttcaccttcaatacctatggcatgcactgggtccgccaggctccaggcaaggggctggagtgggtggctcttatctcatatgatggaaatgttaaattttatgcagactccgtgaagggccgattcaccatctccagagacaattcaggaaccaccctgtatctgacaaatgaacagcctgagagctggacacgacggctgttttatctgtgngacagagcagctgcttaaa

SEQ ID NO: 462923 - DNA, 491 bp, Homo sapiens
  misc_feature: HEFZJCU01B93L8.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggagcgtggcccagcctgggaggtccctcagactctcctgtgcagcgtctggattcagtttcgctacacatggcatgcactgggtccgccagtctccaggcaaggggctgcagtgggtgcgtttattcgaagcgatgggactcatgaacaatatgcagactccgtgaagggccgattcatcatctccagagacaactccaacaacacactggatctccaaatgaacaagcctgagagtcgaggaccacggccgtactattaattgtgcccttgactttacta

SEQ ID NO: 462924 - DNA, 522 bp, Homo sapiens
  misc_feature: HEFZJCU01ARBUT.16.27.C05.1.454.heavy.3.raw
  modified_base (515)..(515): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggaggccgattcaccgtctccagagacaattccaagaacagggtgttctccaagtgattgatctgagaagtgaggacacggctgtttattactgtgcgcggtggctgaccgctcttgactactggggccgggagccccggtnatcgtct

SEQ ID NO: 462925 - DNA, 506 bp, Homo sapiens
  misc_feature: HEFZJCU01C4EH3.21.4.A04.1.454.heavy.3.raw
  modified_base (454)..(454): a, c, t, g, unknown or other
  modified_base (481)..(481): a, c, t, g, unknown or other
tcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctctgcattcaccttcagtgaccacaacatggactgggtccgccaggctccagggaagggctggagtgggtcggccgtattacaaggaaagctaacagttacagtacagaatacggcgcgtctgtgaaaggaggttcaccatctcaagagatgattcaaagaactcactgtatctgcaaatgaacagcctagaaaaccgnggacacggccgtgtattattgtggtanacaaaagagtaggatgtggtggtag

SEQ ID NO: 462926 - DNA, 490 bp, Homo sapiens
  misc_feature: HEFZJCU01BLGPQ.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggcaccctcctccaagagcacctctgggggcacagcggccctgggctgcctggtcaaggctacttccgagtgcgtct

SEQ ID NO: 462927 - DNA, 393 bp, Homo sapiens
  misc_feature: HEFZJCU01CLVMZ.13.46.E02.1.454.heavy.3.raw
tcacgtactacacgaccggtgctcgatttagactcatctacagggaaaggggctggagtgggtttcatatatcactggtgatagtgcttccacatattacgcagactctatgaagggccgattcaccatctccagagacaatgccaggaactcgctgtatctgcaaatgaacagcctgagagccgatgacacggccgtgtattactgtgcgagagatggggcccacgaacgttactacgctatggacgtctggggccaagggaccacggtcaccgtctcctcagcctccaccaagggcccatcggtcttccccctggcgccctgctccaggagcacctccgagagcacagcggccctgggctgcctggtcaaggactacttcctagtacgtga

SEQ ID NO: 462928 - DNA, 531 bp, Homo sapiens
  misc_feature: HEFZJCU01CSA1N.53.10.A10.1.454.heavy.3.raw
cgcgtatacacacgaccggtgctcgatttagcgtcgatctcaggggtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgccctccaggggggacctttgggggtttcgacccctgggggcccaggggaaccctggtcaccgtctcctcagcctccaccaagggcccatcggtcttccccctggcaccctcctccaagagcacctcg

SEQ ID NO: 462929 - DNA, 517 bp, Homo sapiens
  misc_feature: HEFZJCU01BZNKN.9.34.D01.1.454.heavy.3.raw
tgatacgtctcacgaccggtgctcgatttagatcgtctgtgttggggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggcctgggctgcctggtcaaggactactccagacgtatca

SEQ ID NO: 462930 - DNA, 495 bp, Homo sapiens
  misc_feature: HEFZJCU01BZ96Y.49.85.H08.1.454.heavy.3.raw
agtcgagagacacgaccggtgctcgatttagtatcactcagtcgcgggggtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcagcttctctgggttctcactctccagtcctggagtgggtgtgggctggatccgtcagcccccaggaaaggccctggagtggcttgcactcatttattggaatgacgataagacctacagcccatctctgaagagcaggctcaccatcaccaaggacacctccaacaaccaggtggtccttacaatgaccaacatggaccctgtggacacagccacatattactgtgcacacgtccccccgccgtacttattatgatgctagtggttattccaacgctgaatacttccagcactgggccagggca

SEQ ID NO: 462931 - DNA, 492 bp, Homo sapiens
  misc_feature: HEFZJCU01C6WMA.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagaggcacagcggccctgggctgcctggtcaaggactacttcccacgagagta

SEQ ID NO: 462932 - DNA, 513 bp, Homo sapiens
  misc_feature: HEFZJCU01C5WLG.53.77.G11.1.454.heavy.3.raw
cgcgtatacacacgaccggtgctcgatttagctagtcactcaagggaaagggggagcccagcactagaagtcggcggtgtttccattcggtgatcagcactgaacacagaggactcaccatggagtttgggctgagctgggttttcctcgttgctcttttaagaggtgtccagtgtcaggtgcggctggtggagtctgggggggctggtccagcctgggaggtccctgagactctcctgtgcagcgtctggattcagtctcagcatctatggcgtgcattgggtccgccaggctccaggcaaggggcttgagtgggtggcagttatgtactatgatggaagtaataaatattatgcagacttcgtgaagggccgattcaccatctccagagacagttccaaggacatcctgtatctccaaatgaacagcctgagacccgaggacacggctgtctactactgtgcggagggggggacgtagatttggtggctacgatcaccccctattttttcg

SEQ ID NO: 462933 - DNA, 512 bp, Homo sapiens
  misc_feature: HEFZJCU01BSOIT.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaaatttggcgggctactacgagaacggattgggcgcctggggccaagggaccacggtcatcgtctccgcagcctccaccaaggcccatcggtcttcccctggcaccctcctccaagagcacctctgggggcacagcggccctgggctgcctggtcaaggactacttccgagtgcgtct

SEQ ID NO: 462934 - DNA, 516 bp, Homo sapiens
  misc_feature: HEFZJCU01CSBW8.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatatgggaagtacgattttcgatccctccgcagtcgacactttgattactggggccggggaaccctggtcgccgtctcctcagcctccaccaagggcccatcggtcttcccctgcaccctcctccaagagcacctctgggggcacagcggccctgggctgcctggtcaaggactacttccagacgtatca

SEQ ID NO: 462935 - DNA, 490 bp, Homo sapiens; identical to SEQ ID NO: 456449
  misc_feature: HEFZJCU01BJ7K3.11.38.D05.1.454.heavy.3.raw

SEQ ID NO: 462936 - DNA, 512 bp, Homo sapiens
  misc_feature: HEFZJCU01CEYME.51.5.A05.1.454.heavy.3.raw
cgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagagtgagttctccctgaggctgacgtctttaagtgtcgctgatacgggtgtctatttctgtgcgagactgcccggtctgcacctcgtgtggcccaatttggtttaccggcacacaaaatcagggcaagtcctacgacggtctggtacg

SEQ ID NO: 462937 - DNA, 505 bp, Homo sapiens
  misc_feature: HEFZJCU01A8F3R.48.59.F04.1.454.heavy.3.raw
agtatacatacacgaccggtgctcgatttagtacacacacttagggattgggggcttttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgt

SEQ ID NO: 462938 - DNA, 496 bp, Homo sapiens; identical to SEQ ID NO: 444697
  misc_feature: HEFZJCU01BAET9.16.37.D04.1.454.heavy.3.raw

SEQ ID NO: 462939 - DNA, 505 bp, Homo sapiens
  misc_feature: HEFZJCU01BMPCC.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaaccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcctccaccaagggcccatcggtcttcccctggcgccctgctccaggagcacctccgagagcacagcggccctgggctgcctggtcaaggactactcc

SEQ ID NO: 462940 - DNA, 508 bp, Homo sapiens
  misc_feature: HEFZJCU01BNB9C.9.12.B01.1.454.heavy.3.raw
tgatacgtctcacgaccggtgctcgatttagtagtgtagattccgcggggtgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagcctggggggtccctgaaactctcctgtgcagcctctggatacaccgtcagtagtaactccatgaactgggtccgccaggctccagggaaggggctggagtgggtctcagttatttatagcggtggtaacacatactacgcagactccgtgaagggcagattcaccatctccagagacaattccaggaacacgctgtatcttcaaatgaacagcctgagagtcgaggacacggctgtatattactgtgcgagagatgtgtacgcttttgatatctggggccaaggggac

SEQ ID NO: 462941 - DNA, 531 bp, Homo sapiens; identical to SEQ ID NO: 446857
  misc_feature: HEFZJCU01CPQJW.7.78.H01.1.454.heavy.3.raw

SEQ ID NO: 462942 - DNA, 520 bp, Homo sapiens
  misc_feature: HEFZJCU01BL0HL.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaaccctggtcgccgtctcctcagcctccaccaagggcccatcggtcttccccctggccaccctccctccaagagccacctcgtgggggcacagcggccctgggctgcctggtacaaggactacttccagacgta

SEQ ID NO: 462943 - DNA, 516 bp, Homo sapiens
  misc_feature: HEFZJCU01E1EHC.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacaccggccatatattactgttgcgaaagcaccggcagttagtcaccccatacctactttgtactactggggtacc

SEQ ID NO: 462944 - DNA, 470 bp, Homo sapiens; identical to SEQ ID NO: 445307
  misc_feature: HEFZJCU01B5K9V.12.78.H01.1.454.heavy.3.raw

SEQ ID NO: 462945 - DNA, 510 bp, Homo sapiens
  misc_feature: HEFZJCU01DDPGH.52.1.A01.1.454.heavy.3.raw
cgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatgtccctcacctgctctgtctctggtgactccatcagcagtggttattactgggcctgggtccggcagcccccagggaaggggtttgagtggattgggagtatcgatcacagtgggagcacctacctgaacccgtccctcacgactcgagtcgccatatcaacagacacgtccaagaaccagttctacctgaggctgaactctgtgaccgccgcagacacggccgtatattattgtgcgcgggacttcgaggggtggatatagtggctacgatttcgtatctccttgactacgtggggccagggaccctggtcaccgtct

SEQ ID NO: 462946 - DNA, 508 bp, Homo sapiens
  misc_feature: HEFZJCU01CZX5N.3.85.H08.1.454.heavy.3.raw
  modified_base (340)..(340): a, c, t, g, unknown or other
agacgcactccacgaccggtgctcgatttagtatcactcagtcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctggtggagtctgggggaggcttggtacagcctggggggtccctgagactctcctgtgcagcctctggattcacctttagtaattatgccatgagctgggtccgccaggctccagggaagggctggagtgggtctcagctattagngatcgtggtggtaacacatactacgcagactccgtgaagggccgcttcaccatctccagagacaattccaagaacacgctgcatctgcaaatgaacagcctagagagccgaggacacggcccttttatactgtcgacgaaaccatacacgtataactggaactacgta

SEQ ID NO: 462947 - DNA, 524 bp, Homo sapiens
  misc_feature: HEFZJCU01A6FE5.51.62.F07.1.454.heavy.3.raw
cgatcgtatacacgaccggtgctcgatttagtagtcgcataaagggaaagggggcatcacataacaaccagattcctcctctaaagaagcccctgggagcacagttcatcaccatggactggacctggaagttcctctttgtggtggcagcagcaacaggtgtccagtcgcaggtccagctggtgcagtctgggactgaggtgaagaggcctgggtcctcggtgaaggtctcctgcaaggcatctaaaaacatcttaagaagttatgacatcgcctgggtgcgacaggcccctggacatgggcttgagtgggtgggcaggatcatccctatgtttggagtcgcaaactacgcacagaagttccggggcaaagtcacgttgaccgcggacacagtcacggacacagcctacatggaactcaacggcctcagatttgaggacacggccgtctattattgtgcgagagtgagaaattacggtggctactcccttgactactggggccaggggaaccctggtctaccg

SEQ ID NO: 462948 - DNA, 379 bp, Homo sapiens; identical to SEQ ID NO: 444450
  misc_feature: HEFZJCU01EZH9F.47.77.G11.1.454.heavy.3.raw

SEQ ID NO: 462949 - DNA, 519 bp, Homo sapiens
  misc_feature: HEFZJCU01ESW75.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggctttgtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtgtcatagacctaggatacaacgacggtggtacctggtaattc

SEQ ID NO: 462950 - DNA, 401 bp, Homo sapiens
  misc_feature: HEFZJCU01CUTJF.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggcctgcctggtcaaggactacttcctacgtgagct

SEQ ID NO: 462951 - DNA, 503 bp, Homo sapiens; identical to SEQ ID NO: 461447
  misc_feature: HEFZJCU01EUK9X.17.25.C03.1.454.heavy.3.raw
  modified_base (435)..(435): a, c, t, g, unknown or other

SEQ ID NO: 462952 - DNA, 501 bp, Homo sapiens
  misc_feature: HEFZJCU01DLO4E.11.71.G05.1.454.heavy.3.raw
  modified_base (385)..(385): a, c, t, g, unknown or other
cgagagataccacgaccggtgctcgatttagtgtcgtcgcaagagagagggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgnttcaccgtctccagagacaattccaggcaacacgctgtatctgcaaatgaacagcctgagagctgagacacggctgtgtattactgtgacgaaagatttctatagaggtgacgtac

SEQ ID NO: 462953 - DNA, 468 bp, Homo sapiens
  misc_feature: HEFZJCU01B7OGA.52.8.A08.1.454.heavy.3.raw
cgcagtacgacacgaccggtgctcgatttagcatactctaccagggggctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcttgtgcagcctctggattcaccttcagggtctatgacatgcactgggtccgccaggcctccaggcaaggggctggagtgggtggcagttatatcatatgatggaagcaagatatactatgtagactccgtgaagggccgattcatcatctccagagacaactccgagaacacgctgtatctgacaatgaacaggctgagagctagaagacacggctgtatatact

SEQ ID NO: 462954 - DNA, 498 bp, Homo sapiens
  misc_feature: HEFZJCU01CNI6R.10.21.B10.1.454.heavy.3.raw
  modified_base (425)..(425): a, c, t, g, unknown or other
catagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcccggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacaatggngtatctgcaaatgaccagccctgagagccgaggacacgggtgtttattactgttgggagaagtacctagtggc

SEQ ID NO: 462955 - DNA, 316 bp, Homo sapiens; identical to SEQ ID NO: 444479
  misc_feature: HEFZJCU01AVUNH.47.84.H07.1.454.heavy.3.raw

SEQ ID NO: 462956 - DNA, 519 bp, Homo sapiens
  misc_feature: HEFZJCU01BDDVK.48.68.G02.1.454.heavy.3.raw
agtatacatacacgaccggtgctcgatttagtcgatagtgaagggaaaggggctgggagaggagccccagccctgagattcccaggtgtttccattcagtgatcagcactgaacacagaggactcaccatggagttgggactgaactggattttccttttggctattttaaaaggtgtccagtgtgaactgcaactggtggagtctgggggaggcttggtacagcctggcaggtccctgagactctcctgtgcagcctctggattcacctttggtgattatgccatgcactgggtccggcaagctccagggaagggcctggagtgggtctcaggtattagttggaatagtgatagcataggctatgcggactctgtgaagggccgattcaccatctccagagacaacgccaagaactccctgtatctgcaaatgaacagtctgagaactgaggacacggccttgtattactgtgtaaaagatatgatttttgggggttcggggtagttggaggcggtcg

SEQ ID NO: 462957 - DNA, 483 bp, Homo sapiens
  misc_feature: HEFZJCU01C1ZLF.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagccctccaccaagggcccatcggtcttcccctggcaccctcctccaagagcacctctgggggcacagcggccctgggctgcctggtcaaggactacttccgtatctctcg

SEQ ID NO: 462958 - DNA, 500 bp, Homo sapiens
  misc_feature: HEFZJCU01C2M4Z.53.61.F06.1.454.heavy.3.raw
cgcgtatacacacgaccggtgctcgatttagctacgctctaagggaaagggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcacctagtggagtctgggggaggcgtcgtccaccctggggggtccctgagactctcctgtgcagcctctggattcaccttcagagtctatggcatgcactgggtccgccaggctccaggcaaggggctggagtgggtggcacttatatcagatgatggaagtgatacatactatggagactccgtgaagggccgattcaccatctcgagagacaattccaggaacacgctgtatctgcaaatgaacggcctgagagctgaggacacggctgtgtattactgtgcgaacggttgagtgggattagggg

SEQ ID NO: 462959 - DNA, 532 bp, Homo sapiens
  misc_feature: HEFZJCU01DML4Q.19.48.E04.1.454.heavy.3.raw
tactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagcctggggggtccctgagactctcctgtacaggctctgggttctcctttagtagttattggatgaactgggcccgccaggctccggggaaggggccggagtgggtggccaacataatgcaagatggaactgagaaaaactatggggactctgtgaagggccgattcaccatctccagagacaaccgtaagaacttactgtttctgcaaatgaacagcctgagagccgaggacacggctgtgtattattgtgcgaagggcagtggctgggacatggacgtcgtggggccaagggaccacggtcaccgt

SEQ ID NO: 462960 - DNA, 490 bp, Homo sapiens; identical to SEQ ID NO: 449137
  misc_feature: HEFZJCU01CWNGK.11.26.C04.1.454.heavy.3.raw

SEQ ID NO: 462961 - DNA, 543 bp, Homo sapiens
  misc_feature: HEFZJCU01AVZV6.52.35.D02.1.454.heavy.3.raw
cgcagtacgacacgaccggtgctcgatttagcacacgatagttgggtttgggctgagcgtggctctttacgttgtggctattttaaaaggtgtccagtgtgacgtacagctggtggagtcggggggagccttccaacacccgggggggtccctgagactcacctgtgaagcctctggatttagattttagcagccatgccatgacctgggtccgccaggctccaggtcaggggctggagtgggtctcaggtattagcggaactggtgataccacgtactacgcggactctgtgaagggccgcttcaccatctctagggacagttccaagaacacgctgtatctgcaaatgaatagcctgagagtcgaggacacggccgtttattactgtgcgaaagatcgaggtcgcatgacagtttttggagttggccaaagacggcaggttccgctacgggttggacgtctggggccaagggaccacggtcaccgtcgcctcagcctccaccaagggcccatcggcttcccctggcaccctcctccaagag

SEQ ID NO: 462962 - DNA, 526 bp, Homo sapiens
  misc_feature: HEFZJCU01AGI60.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactagtgggggcttgttctggggccaggggaccctggtcatcgtctccccacgcctccaccaacgggcccatcggtccttcccctggccg

SEQ ID NO: 462963 - DNA, 509 bp, Homo sapiens; identical to SEQ ID NO: 454842
  misc_feature: HEFZJCU01AMBUG.2.33.C11.1.454.heavy.3.raw

SEQ ID NO: 462964 - DNA, 506 bp, Homo sapiens
  misc_feature: HEFZJCU01DG6PG.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaaggccatcggtcttcccctggcgcctgctcagagcacctctggggcacagcgccg

SEQ ID NO: 462965 - DNA, 499 bp, Homo sapiens
  misc_feature: HEFZJCU01AJYEZ.48.23.C01.1.454.heavy.3.raw
agtatacatacacgaccggtgctcgatttagtacacgtgattagggattggggatgctttctgagagtcatggatctcatgtgcaagaaaatgaagcacctgtggttcttcctcctgctggtggcggctcccagatgggtcctgtccgagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtgggccgaagggacaatggt

SEQ ID NO: 462966 - DNA, 523 bp, Homo sapiens
  misc_feature: HEFZJCU01BSUDJ.2.81.H04.1.454.heavy.3.raw
acgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagttggtggagtccgggggaggctgggtccagcctggggggtccctgagactctcctgttcagcctctggattcacctttagtaggttttggatgagttgggtccgccaggctccagggaaggggctggagtgggtggccaacatagagtacgatggaagtgagaaaactatgtggactccgtgaagggccgattcaccatctccagagacaacgacaagaatttagtgtatctgcaaatgagcagcctgagagccgaggacacgggctgtgtattattgtgcgagag

SEQ ID NO: 462967 - DNA, 502 bp, Homo sapiens
  misc_feature: HEFZJCU01B2NR0.14.78.H01.1.454.heavy.3.raw
cgtctagtaccacgaccggtgctcgatttagtgtgagtagtttgggtttggggagctctgggagaagagccccagccccagagttcccaggagtttccattcggtgatcagcactgaacacagaggactcaccatggagtttgggctgagctgggtcttccttgttgctattataaaaggtgtccagtgtcaagtgcagttggtggagtctgggggaggcttggtcaagcctggagggtccctgagactctcctgtgcagcctctggattcaccttcagtgactactacatgacctggatccgccaggcgccagggaagggctggaatggattgcatacattcactatagtggaaatgcagtgtcctagcagactctctgaagggccgattcaccgtctccagggacaacgccaagaactcgctgtatctgcaaatcgacggcctgagagtcgaggacacggccatgtattactgtgcgagagtgtggttcggtcatgtttt

SEQ ID NO: 462968 - DNA, 399 bp, Homo sapiens
  misc_feature: HEFZJCU01DXANU.49.27.C05.1.454.heavy.3.raw
agtcgagagacacgaccggtgctcgatttagacgcgatcgaagggtttggggaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaa

SEQ ID NO: 462969 - DNA, 489 bp, Homo sapiens
  misc_feature: HEFZJCU01EHU8Y.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctcagagcacctccgagagcacagcggccctgggctgcctggtcaaggactacttcccacgagagta

SEQ ID NO: 462970 - DNA, 515 bp, Homo sapiens
  misc_feature: HEFZJCU01ETEP7.51.5.A05.1.454.heavy.3.raw
cgatcgtatacacgaccggtgctcgatttagatagatagacagggggctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagagtgagttctccctgaggctgacgtctttaagtgtcgctgatacgggtgtctatttctgtgcgagctgcccggtcctgcacctcgtgtcggcccctaatttcggtttaccggcacaacaaatcagggcaagtcctacgacggtctggacgtc

SEQ ID NO: 462971 - DNA, 512 bp, Homo sapiens; identical to SEQ ID NO: 445688
  misc_feature: HEFZJCU01EW40X.3.34.D01.1.454.heavy.3.raw

SEQ ID NO: 462972 - DNA, 413 bp, Homo sapiens
  misc_feature: HEFZJCU01A3WON.51.60.F05.1.454.heavy.3.raw
cgatcgtatacacgaccggtgctcgatttagtacgtcatcagggaaagggactggagtggattggatatatctattacaatgggaggaccgactacaacccctccctcaagagtcgagtcaccatatcagttgactcgtccaagaagcagttctccctgaagctgaactctgtgaccgctgcggacacggccgtgtatttctgtgcgaaagttcaggccccatattattatgacagtagtggttatcaaataggggcctactttgaccactggggccggggaaccctggtcaccgtctcctcagcctccaccaagggcccatcggtcttccccctggcaccctcctccaagagcacctctgggggcacagcggccctgtgctgcctggtcaaggactacttcctcgtagcact

SEQ ID NO: 462973 - DNA, 409 bp, Homo sapiens; identical to SEQ ID NO: 444519
  misc_feature: HEFZJCU01A9AND.3.41.D08.1.454.heavy.3.raw

SEQ ID NO: 462974 - DNA, 488 bp, Homo sapiens; identical to SEQ ID NO: 444617
  misc_feature: HEFZJCU01BF24N.4.6.A06.1.454.heavy.3.raw

SEQ ID NO: 462975 - DNA, 505 bp, Homo sapiens; identical to SEQ ID NO: 448458
  misc_feature: HEFZJCU01DS23X.16.34.D01.1.454.heavy.3.raw

SEQ ID NO: 462976 - DNA, 413 bp, Homo sapiens; identical to SEQ ID NO: 452062
  misc_feature: HEFZJCU01D2NQU.40.81.H04.1.454.heavy.3.raw

SEQ ID NO: 462977 - DNA, 527 bp, Homo sapiens
  misc_feature: HEFZJCU01D2TUO.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctgttattgtgtcagagatccggccataactggctcggccctggggcccggaaccctggtcaccgtctcctcagcctccaccaaggcccatcggtcttcccctggccaccctcctcc

SEQ ID NO: 462978 - DNA, 511 bp, Homo sapiens
  misc_feature: HEFZJCU01DRXP4.51.12.B01.1.454.heavy.3.raw
cgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcagggtcatcatgaccgggacacgtccatcgccacaacttacatggaactgaccagtctgacatttgacgacacggccgtctattactgtgcgacagaagcggcggacagaggttcgcttactggttcgaggctctccccctacg

SEQ ID NO: 462979 - DNA, 526 bp, Homo sapiens
  misc_feature: HEFZJCU01B77JH.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaacgggccgattaaccatctccagagacgattccgagaacacggtgtatcttcaaatgaacaacctgagagccgacgacacggccgtttattactgtgcgagagattcgagtggttcggggacctcaccctggttctacttcgatctctggggccgtc

SEQ ID NO: 462980 - DNA, 518 bp, Homo sapiens; identical to SEQ ID NO: 446027
  misc_feature: HEFZJCU01BNZNZ.9.34.D01.1.454.heavy.3.raw

SEQ ID NO: 462981 - DNA, 525 bp, Homo sapiens
  misc_feature: HEFZJCU01DVMK3.17.34.D01.1.454.heavy.3.raw
  modified_base (500)..(500): a, c, t, g, unknown or other
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactatacactgctcctttttacacctccttnacttctgggccatggaacccggtcc

SEQ ID NO: 462982 - DNA, 507 bp, Homo sapiens
  misc_feature: HEFZJCU01BMVCH.52.34.D01.1.454.heavy.3.raw
cgcagtacgacacgaccggtgctcgatttagatcgtctgtgttgggtctgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttcccctggcaccctcctccaagagcacctcctgggggcacagcggccctgggctgcctggtcaaggactacttcctatacgatcg

SEQ ID NO: 462983 - DNA, 498 bp, Homo sapiens; identical to SEQ ID NO: 445952
  misc_feature: HEFZJCU01AQGP6.11.71.G05.1.454.heavy.3.raw

SEQ ID NO: 462984 - DNA, 528 bp, Homo sapiens
  misc_feature: HEFZJCU01A225S.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggacctggtcatcgtctccccagcctccaccaagggcccatcggtcttccccctggccgccctcg

SEQ ID NO: 462985 - DNA, 500 bp, Homo sapiens; identical to SEQ ID NO: 445028
  misc_feature: HEFZJCU01D2DTC.13.12.B01.1.454.heavy.3.raw

SEQ ID NO: 462986 - DNA, 533 bp, Homo sapiens
  misc_feature: HEFZJCU01DR33I.19.48.E04.1.454.heavy.3.raw
tactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagcctggggggtccctgagactctcctgtacaggctctgggttctcctttagtagtttattggatgaactgggcccgccaggctccggggaaggggccggagtgggtggccaacataatgcaagatggaactgagaaaaactatgggactctgtgaagggccgattcaccatctccagagacaaccgtaagaacttactgtttctgcaaatgaacagcctgagagccgaggacacggctgtgtattattgtgcgaagggcagtggctgggacatggacgtctggggccaagggaccacggtcaaccggt

SEQ ID NO: 462987 - DNA, 505 bp, Homo sapiens
  misc_feature: HEFZJCU01BH4II.48.23.C01.1.454.heavy.3.raw
agtatacatacacgaccggtgctcgatttagtacacgtgattagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctacaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtggggccaagggacaagtggtcaccgt

SEQ ID NO: 462988 - DNA, 410 bp, Homo sapiens
  misc_feature: HEFZJCU01DWYSA.13.46.E02.1.454.heavy.3.raw
tcacgtactacacgaccggtgctcgatttagactcatctacagggaaaggggctggagtgggtggccaacataaaggaggatgggagtcagacatattatgtggagtctgtgcggggccgattcaccatttccagagacaacgccagatcgtcagtatatctgcaaatgaggagcctgagagtcgatgatacggctacatattattgtgcgagaattgacagttttccagacggcgactacgttgtcggctggggcgactttgacatttggggccaagggacactggtcaccgtctcccaagcttccaccaagggcccatcggtcttccccctggcgccctgctccaggagcacctctgggggcacagcggccctgggctgcctggtcaagactacttcctagtacgtga

SEQ ID NO: 462989 - DNA, 396 bp, Homo sapiens; identical to SEQ ID NO: 444469
  misc_feature: HEFZJCU01EVV79.47.46.E02.1.454.heavy.3.raw

SEQ ID NO: 462990 - DNA, 512 bp, Homo sapiens
  misc_feature: HEFZJCU01BL8NL.53.70.G04.1.454.heavy.3.raw
cgcgtatacacacgaccggtgctcgatttagtgtagtgtgaagggaaagggtggagtctgggggagacttgatacagcctggcaggtccctgagactctcctgtgcagcctctggattcacgtttgatgattctgtcatgcactgggtccggcaaactccagggaagggcctggagtggctctcaggcattacttggaatagtggcagtacaggttatgcggactctgtgaagggccgattcaccatctccagagacaacagcaaggagctcctttatttacaaatggacagcctgagagttgaggacacggccgtatattactgtgtgaaagacagcggcccacctcgcagttggtattactattacgggatggacatctggggccgagggaccacggtcaccgtctcctcagcctccaccaagggcccatcggtcttcccctggcgccctgctccaggagcacctccgagagcacagcggccctgggctgcctggtcaaggactacttcc

SEQ ID NO: 462991 - DNA, 483 bp, Homo sapiens; identical to SEQ ID NO: 444932
  misc_feature: HEFZJCU01ASUDN.7.10.A10.1.454.heavy.3.raw

SEQ ID NO: 462992 - DNA, 497 bp, Homo sapiens
  misc_feature: HEFZJCU01D154L.10.21.B10.1.454.heavy.3.raw
catagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatcctagtggctac

SEQ ID NO: 462993 - DNA, 503 bp, Homo sapiens
  misc_feature: HEFZJCU01DY1JA.3.20.B09.1.454.heavy.3.raw
  modified_base (435)..(435): a, c, t, g, unknown or other
agacgcactccacgaccggtgctcgatttagtgtagtgtgaagggacagggtctccgaaggcttcaccaagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcacggagtcgggtcaccatatcagtagacacgtccaagagccagttctccctgaagctgagggctgtgagcgccgcagacacggccgtgtattacngtgcgagctggccgcaacagactacggtggcaactcctatgcttttgatactctggggccaagggtac

SEQ ID NO: 462994 - DNA, 517 bp, Homo sapiens
  misc_feature: HEFZJCU01BU5FO.7.78.H01.1.454.heavy.3.raw
cgtgtctctacacgaccggtgctcgatttagtgtgagtagtttgggtttgggattcgcgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaaggcccatcggtcttcccctggcaccctcctccaagagcacctctgggggcacagcggccctgggctgcctggtcaaggactacttcctagagacacg

SEQ ID NO: 462995 - DNA, 498 bp, Homo sapiens
  misc_feature: HEFZJCU01D938N.13.39.D06.1.454.heavy.3.raw
tcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtcgtggggccaagggaccacggtcaccgtctcctcagcctccacc

SEQ ID NO: 462996 - DNA, 498 bp, Homo sapiens
  misc_feature: HEFZJCU01B1KRG.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttccccctcggcaccctcctccaagagcacctctgggggcacagcggccctgggctgcctggtcaaggactacttccgagtagtaca

SEQ ID NO: 462997 - DNA, 514 bp, Homo sapiens
  misc_feature: HEFZJCU01D2DB4.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatcggtccttccccctggtccgccctcgctcccgaggacg

SEQ ID NO: 462998 - DNA, 531 bp, Homo sapiens
  misc_feature: HEFZJCU01DB7JR.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagatcgtccctatcgttgacacaccaaactacgcacagaagttccagggcagactcaccataaccgcggaacaaattaacgaacacagttaatctgagctagaacagcctgtcatctgaggacacgggcttctacttctgtgcgaggagtaattactataacactgcttccttttacaccttccttcgacttcgtgggccatcggaacccggtccg

SEQ ID NO: 462999 - DNA, 496 bp, Homo sapiens
  misc_feature: HEFZJCU01EFJQT.14.25.C03.1.454.heavy.3.raw
cgtctagtaccacgaccggtgctcgatttagtagtgtagatttgggtttggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgagggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactggtgggagagatgggaggtcgatattgta

SEQ ID NO: 463000 - DNA, 496 bp, Homo sapiens
  misc_feature: HEFZJCU01DDIWQ.40.37.D04.1.454.heavy.3.raw
tctagcgactcacgaccggtgctcgatttagtagcatactgttgggtttgggggaggcttggtacagcctggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcaggaagtgggagctggtaggcctcaatactggggccggggaatcctggtcaccgtctcctcagcctccaccaagggcccatcggtcttcccctggcgccctgctccaggagcacctccgagagcacagcggccctgggctgcctggtcaaggactacttccagcgctaga

SEQ ID NO: 463001 - DNA, 507 bp, Homo sapiens
  misc_feature: HEFZJCU01CB2VP.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgccctgctccaggagcacctctggggcacagcggccctgggctgcctgtcaggactactcccata

SEQ ID NO: 463002 - DNA, 528 bp, Homo sapiens
  misc_feature: HEFZJCU01AWMND.18.33.C11.1.454.heavy.3.raw
tacgagtatgcacgaccggtgctcgatttagagtgagctcgttgggtttggggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaatgaataacctgagagccgaggacacggccatgtattactgtgtggggcatttacttgaccctggggccggggaaccctggtcaccgtctccccaccctccaccg

SEQ ID NO: 463003 - DNA, 501 bp, Homo sapiens
  misc_feature: HEFZJCU01B1QQ3.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtcttccccgtggcgccctgctccaggagcacctccgagagcacagcggccctgggctgcctggtcaaggactacttcctacgtcgtat

SEQ ID NO: 463004 - DNA, 509 bp, Homo sapiens
  misc_feature: HEFZJCU01A6B4B.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaacacagggactgcagtggattggatacatctacttcagtgggaaccccaactacaaccctccctcaggagtccagtcgccatatccctggactcgtccaacaaccagatctccctgacgatgacatctgtgaccgctgcggacacagccgtttattactgtgcgcgatctgggcgactcagtgactatggtatggacgtctggggccaagggaccacggtcatcgtctcctcagcctccaccaagggcccatcggtcttcccctggc

SEQ ID NO: 463005 - DNA, 400 bp, Homo sapiens; identical to SEQ ID NO: 444452
  misc_feature: HEFZJCU01ESH9J.47.24.C02.1.454.heavy.3.raw

SEQ ID NO: 463006 - DNA, 390 bp, Homo sapiens; identical to SEQ ID NO: 444541
  misc_feature: HEFZJCU01DWK70.16.24.C02.1.454.heavy.3.raw

SEQ ID NO: 463007 - DNA, 528 bp, Homo sapiens
  misc_feature: HEFZJCU01D9T63.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgactttgggcagggaaccctggtcaccgtctcctcagcctccaccaagggcccatcggtcttcccctggcaccctcctccaagagcacctctgggggcacagcggccctgggctgcct

SEQ ID NO: 463008 - DNA, 491 bp, Homo sapiens; identical to SEQ ID NO: 444592
  misc_feature: HEFZJCU01B7T36.11.26.C04.1.454.heavy.3.raw

SEQ ID NO: 463009 - DNA, 500 bp, Homo sapiens; identical to SEQ ID NO: 454641
  misc_feature: HEFZJCU01AD6YQ.10.55.E11.1.454.heavy.3.raw

SEQ ID NO: 463010 - DNA, 500 bp, Homo sapiens; identical to SEQ ID NO: 445720
  misc_feature: HEFZJCU01BAZH5.3.20.B09.1.454.heavy.3.raw

SEQ ID NO: 463011 - DNA, 430 bp, Homo sapiens; identical to SEQ ID NO: 444675
  misc_feature: HEFZJCU01DHQ85.40.34.D01.1.454.heavy.3.raw

SEQ ID NO: 463012 - DNA, 508 bp, Homo sapiens
  misc_feature: HEFZJCU01DBLNB.2.33.C11.1.454.heavy.3.raw
acgctcgacacacgaccggtgctcgatttagagtgagctcgttgggtttggggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggagcttggtgcagccgggtgggtccctgcgactctcctgtgcaatttctgaagcccttccaatacagtgtggatgaattgggtccgccaggctccagggaaggggctggagtgggttggccatataaaagtaagactgctggtgagacaacagactacgctgctgccttcagaggcagattcaccatcttcagagatgaatcacagagcactctgtttctgcaaatgaacagcctggaagacgcggacacagcccatgtattattgtacattaggacactatagtccctggggccaggggaaccctc

SEQ ID NO: 463013 - DNA, 529 bp, Homo sapiens
  misc_feature: HEFZJCU01C558Q.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacggctgtttattactgtgcgcggtggctgaccgctcttgactacgtgggggccggggagccccgggtcagtcgtct

SEQ ID NO: 463014 - DNA, 512 bp, Homo sapiens
  misc_feature: HEFZJCU01BSS54.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactgggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtacacccatactactttgactactggggccg

SEQ ID NO: 463015 - DNA, 512 bp, Homo sapiens
  misc_feature: HEFZJCU01BZ4P6.9.12.B01.1.454.heavy.3.raw
tgatacgtctcacgaccggtgctcgatttagtagtgtagattccgcgggggctctgggagaggagcccagcactgggattccgaggtgtttccattcagtgatctgcactgaacacagaggactcgccatggagtttgggctgagcgtggttttccttgttagctattttaaaaggtgtccagtgtgaggtgcagctggtggagtctgggggaggcttggtccagcctgggggtccctgaactctcctgtgcagcctctggatacaccgtcagtagtaactccatgaactgggtccgccaggctccagggaaggggctggagtgggtctcagtttatttatagcggtggtaacacatactacgcagactccgtgaagggcagattcaccatctccagagacaattccaggaacacgctgtatcttcaaatgaacagcctgagagtcgaggacacggctgtatattactgtgcgagagatgtgtacgcttttgatatctggggaccaagggga

SEQ ID NO: 463016 - DNA, 507 bp, Homo sapiens
  misc_feature: HEFZJCU01ENMHS.40.31.C09.1.454.heavy.3.raw
tctagcgactcacgaccggtgctcgatttagacgtctcatcaaggaaggaagggggcttttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctatactgtgcgaggccccgagcgcagtgcttttgatgcctttgattatgtgggccgaagggacaagtaggtctaccg

SEQ ID NO: 463017 - DNA, 486 bp, Homo sapiens; identical to SEQ ID NO: 448316
  misc_feature: HEFZJCU01CZA11.3.48.E04.1.454.heavy.3.raw

SEQ ID NO: 463018 - DNA, 522 bp, Homo sapiens; identical to SEQ ID NO: 455806
  misc_feature: HEFZJCU01A6MQA.16.86.H09.1.454.heavy.3.raw
  modified_base (497)..(497): a, c, t, g, unknown or other

SEQ ID NO: 463019 - DNA, 491 bp, Homo sapiens
  misc_feature: HEFZJCU01CZRHP.10.29.C07.1.454.heavy.3.raw
  modified_base (480)..(480): a, c, t, g, unknown or other
catagtagtgcacgaccggtgctcgatttagagtgctacgaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggaatccccttcagtacctatggcatgcactgggtccgccaggctccaggcaaggggctggagtgggtggcagccatatcgtatgatgtaactaataaatactatgcagactccgtgaagggccgattcaccatctccagagacaatttcaagaacacgctgtttctgcaaatgaacagcctgagagctgaggacacggctgtgtattactgtgcgaaagntatcgcggtga

SEQ ID NO: 463020 - DNA, 507 bp, Homo sapiens
  misc_feature: HEFZJCU01C3BIP.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctgggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgcgaagatctcgggctggttccgcggtccggg

SEQ ID NO: 463021 - DNA, 379 bp, Homo sapiens; identical to SEQ ID NO: 444450
  misc_feature: HEFZJCU01EKAAU.47.77.G11.1.454.heavy.3.raw

SEQ ID NO: 463022 - DNA, 498 bp, Homo sapiens
  misc_feature: HEFZJCU01EBHSK.51.37.D04.1.454.heavy.3.raw
  modified_base (301)..(301): a, c, t, g, unknown or other
  modified_base (355)..(355): a, c, t, g, unknown or other
cgatcgtatacacgaccggtgctcgatttagtagcatactgttgggtttgggggctctgggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtaaaccgtccggattcaccttcagtaactatgcaatgcactgggtccncaggctccaggcaaggggctggactgggtggcaggcatatcatttgatgggaancaagaagtactatgcagactccgtgaagggccgattcaccatctccagagacagttccgatgacacagtctatctacacatgagcagtgtgagacctgacgacacggcttcttttttactgttgcgccaggaagcagtggctc

SEQ ID NO: 463023 - DNA, 485 bp, Homo sapiens
  misc_feature: HEFZJCU01C7U36.11.23.C01.1.454.heavy.3.raw
cgagagataccacgaccggtgctcgatttagtacacgtgattagggattgggggcagggtgtacacctgtggttctcggggctgccctttggctttggagatggttttctcgatggggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttccccctggcaccctcctccaagagcacctctgggggcacagcggccctgggctgcctggtcaaggactacttccgtatctctcg

SEQ ID NO: 463024 - DNA, 372 bp, Homo sapiens; identical to SEQ ID NO: 444513
  misc_feature: HEFZJCU01BY5H0.5.23.C01.1.454.heavy.3.raw

SEQ ID NO: 463025 - DNA, 500 bp, Homo sapiens; identical to SEQ ID NO: 454641
  misc_feature: HEFZJCU01ATLPX.10.55.E11.1.454.heavy.3.raw

SEQ ID NO: 463026 - DNA, 503 bp, Homo sapiens; identical to SEQ ID NO: 445995
  misc_feature: HEFZJCU01B6H7Q.17.25.C03.1.454.heavy.3.raw

SEQ ID NO: 463027 - DNA, 506 bp, Homo sapiens
  misc_feature: HEFZJCU01CAZ7M.16.71.G05.1.454.heavy.3.raw
tgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagccaccggcagttagtcacccta

SEQ ID NO: 463028 - DNA, 475 bp, Homo sapiens; identical to SEQ ID NO: 457107
  misc_feature: HEFZJCU01CTGFS.10.38.D05.1.454.heavy.3.raw

SEQ ID NO: 463029 - DNA, 507 bp, Homo sapiens
  misc_feature: HEFZJCU01A1472.48.44.D11.1.454.heavy.3.raw
agtatacatacacgaccggtgctcgatttagcgcagtacgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattcccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttccccctggcgccctgctccaggagcacctccgagagcacagcggccctgggctgcctggtcaggactacttcctatgtatact

SEQ ID NO: 463030 - DNA, 501 bp, Homo sapiens
  misc_feature: HEFZJCU01C5DTA.17.10.A10.1.454.heavy.3.raw
  modified_base (460)..(460): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttcngtcatcgtacaatttgataggctctatggactggacttcgt

SEQ ID NO: 463031 - DNA, 396 bp, Homo sapiens; identical to SEQ ID NO: 444469
  misc_feature: HEFZJCU01EC0C5.47.46.E02.1.454.heavy.3.raw

SEQ ID NO: 463032 - DNA, 407 bp, Homo sapiens; identical to SEQ ID NO: 445632
  misc_feature: HEFZJCU01EIDF8.11.67.G01.1.454.heavy.3.raw

SEQ ID NO: 463033 - DNA, 513 bp, Homo sapiens
  misc_feature: HEFZJCU01DD642.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctgggagtgggtggccaacataaatgacgatgcaaaggagacctactatttggactctgtgaggggccgattcatcatctccagagacaacgccgacaactcactgtctctgctgatgagcagcctgagagccgacgaccacggctatctattactgtgcgaaactctcattccgttcatctgaatactggggccagggaaccctggtcgtccg

SEQ ID NO: 463034 - DNA, 535 bp, Homo sapiens
  misc_feature: HEFZJCU01CYBL4.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgaggaaaagtaatggctgtgtttatggggccagggagccctggtcctaccg

SEQ ID NO: 463035 - DNA, 524 bp, Homo sapiens
  misc_feature: HEFZJCU01EEXH9.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccgagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttatactgtgcgagagattcgagtggttcggggacctcaccctggttctacttcgatctctggggccgt

SEQ ID NO: 463036 - DNA, 389 bp, Homo sapiens
  misc_feature: HEFZJCU01C2YKZ.27.46.E02.1.454.heavy.3.raw
agcgtcgtctcacgaccggtgctcgatttagactcatctacagggaaagggactggaatttgtttcagctgttagtcctaatgggggtaacacatattacggagactccgtgaagggcagattcaccatctccagagacaattccaacaatacgttgtatcttcaaatgagcagtctgagagctgaggacacggctacattttattgtggtgaaagtccaagggccggaatacgtactttgactactggggccagggaaccctggtcaccgtctcctcagcttccaccaagggcccatccgtcttccccctggcgccctgctccaggagcacctccgagagcacagccgccctgggctgcctggtcaaggactacttccagacgacgct

SEQ ID NO: 463037 - DNA, 505 bp, Homo sapiens
  misc_feature: HEFZJCU01C52IR.5.41.D08.1.454.heavy.3.raw
atcagacacgcacgaccggtgctcgatttagtcacgcgagaaagggaaagggatgatccgccccagcagctacaggtgtccagtcccaggtgcagctggtgcagtctggggctgccgtgaagaagcctgggtcctcggtgacactctcctgcaaggcgtctggagccaccttcaccaactatgctttcaactgggtgcgacgggcccctgggcagggacttgagtggctggggcggatcatccctaccgttgatgtggcaactatgcacagaagttccagggcagagtcacaattaccgcggacaagtccgcgagcacagcctacatggagctgaacaacctgagatctgaagacacggccgtctattactgtacgacctgcgctacggtgactaccgctctgcttcgggacctatatggtctggacgtctggggccaagggagcactgtcaccgtctcctcagcctccaccaagggcccatcgtcttcccctggccaccctcct

SEQ ID NO: 463038 - DNA, 514 bp, Homo sapiens
  misc_feature: HEFZJCU01ADWP5.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggtatgtctggggccaaggtacagcggtcaccgtcgcctcagcctccaccaagggcccatcggtcttcccctcggtcaccctcctcccaagacgcacctct

SEQ ID NO: 463039 - DNA, 503 bp, Homo sapiens
  misc_feature: HEFZJCU01EEHNN.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgatacggccgtctattactgtgcgagagtcccacgatccggtgagcctacggcagcggcctttgacttctc

SEQ ID NO: 463040 - DNA, 503 bp, Homo sapiens
  misc_feature: HEFZJCU01EDR1Z.7.85.H08.1.454.heavy.3.raw
  modified_base (469)..(469): a, c, t, g, unknown or other
cgtgtctctacacgaccggtgctcgatttagtatcactcagtcgcgggggctctcagagaggtgccttagacctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctggggggtccctgagactctcctgtgcagcctctggatttaccttcagtacttatggcatgaactgggtccgccaggctccagggaagggctgcagtgggtttcacacattaatactggaagtaggaccataacttacacagactctgtgaagggccgattcaccacctccagagacgacgccaagaactcactgtctctgcaaatgaacagcctgagagtcgaggacacggctgtgtattacngtgcgagagatccgggaggggaccgtatcgacct

SEQ ID NO: 463041 - DNA, 537 bp, Homo sapiens
  misc_feature: HEFZJCU01ECLSG.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgttgtcagagatccggcccataactggctcggccctggggcccgggaaccctggtcaccgtctcctcagcctccaccaagggcccatcggtcttcccctcggcaccctcctccaagacg

SEQ ID NO: 463042 - DNA, 509 bp, Homo sapiens
  misc_feature: HEFZJCU01DGXLA.10.38.D05.1.454.heavy.3.raw
catagtagtgcacgaccggtgctcgatttagtatctgatagttggggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatgggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccaggggacg

SEQ ID NO: 463043 - DNA, 496 bp, Homo sapiens; identical to SEQ ID NO: 446592
  misc_feature: HEFZJCU01DGTIA.4.75.G09.1.454.heavy.3.raw

SEQ ID NO: 463044 - DNA, 535 bp, Homo sapiens; identical to SEQ ID NO: 448705
  misc_feature: HEFZJCU01ES7FI.17.28.C06.1.454.heavy.3.raw

SEQ ID NO: 463045 - DNA, 510 bp, Homo sapiens; identical to SEQ ID NO: 457213
  misc_feature: HEFZJCU01C1WGG.7.28.C06.1.454.heavy.3.raw

SEQ ID NO: 463046 - DNA, 504 bp, Homo sapiens
  misc_feature: HEFZJCU01EM3OD.48.44.D11.1.454.heavy.3.raw
agtatacatacacgaccggtgctcgatttagcgcagtacgaggggaggcttggtccagcctggggggtccctgaaactctcctgtacagcctctgggttcgccttcacagcctctgggttcagcttcagtgcctctgctatgcactgggtccgccaggcttccgggagagggcttgagtgggttgccgtattagaacaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttccccctggcgccctgctccaggagcacctccgagagcacagcggccctgggctgcctggtcaaggctacttcctatgtatact

SEQ ID NO: 463047 - DNA, 513 bp, Homo sapiens; identical to SEQ ID NO: 446699
  misc_feature: HEFZJCU01CYDP6.12.25.C03.1.454.heavy.3.raw

SEQ ID NO: 463048 - DNA, 502 bp, Homo sapiens
  misc_feature: HEFZJCU01DB30O.51.23.C01.1.454.heavy.3.raw
cgatcgtatacacgaccggtgctcgatttagtacacgtgattagggattgggggcatcacataacaaccagattcctcctctaaagaagcccctgggagcacagctcatcaccatggactggacctggaggttcctctttgtggtggcagcagttacaggtgtccattcccaggtccagctggtgcagtctggggctgaggtgaagatgcctgggtcctcggtgaaggtctcctgcaagtattctggaggcaccttcagcaactatggtatcagctgggtgcgacaggcccctggacaagggcttgagtggatgggaagggtcacccctatatttgatgtagcagactctgcacagaagttccagggcagaataacaattacggcggacaaatccacgaccacagcctacatggagctgagcagcctgagatctgaggacacggcccttttattactgtgcgagatttaccgtgggggtcacggcggagtatatcgccatta

SEQ ID NO: 463049 - DNA, 489 bp, Homo sapiens; identical to SEQ ID NO: 444791
  misc_feature: HEFZJCU01D68QL.47.85.H08.1.454.heavy.3.raw

SEQ ID NO: 463050 - DNA, 480 bp, Homo sapiens
  misc_feature: HEFZJCU01C2PN9.51.76.G10.1.454.heavy.3.raw
cgatcgtatacacgaccggtgctcgatttagtcactcatacaggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcccgggaggtccctgagactctcctgtgcagcctctggattcaccttcagtgcctatggcatgcactgggtccgccaggctccaggcaaggggctggagtgggtggcatttatatcagatgatggcagtaataaagagtatgcagtctccgtgaagggccgattcaccatctccagagacaattcccagaacacactgtatctgcaaatgaacagattgagagctgaggacacggctgtgtatttctgtgcgaaacgct

SEQ ID NO: 463051 - DNA, 497 bp, Homo sapiens
  misc_feature: HEFZJCU01ERF9X.10.21.B10.1.454.heavy.3.raw
catagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaaggggccgattcaccatcctccagagacaattccaagaacatggtgtatctgcaaatgaccagcctgagagccgaggacacgggtgtttatactgtgggagaaatcctagtggcta

SEQ ID NO: 463052 - DNA, 499 bp, Homo sapiens
  misc_feature: HEFZJCU01BL50P.47.38.D05.1.454.heavy.3.raw
agctcacgtacacgaccggtgctcgatttagtatctgatagttgggtttgggggagagcatcacccagcaaccacatctgtcctctagagaatcccctgagagctccgttcctcaccatggactggacctggaggatcctcttcttggtggcagcagccacaggagtccactcccagttgcaactggtgcagtctggggctgaggtgaagaagcctggggcctcagtgaaggtctcctgcaaggcttctggatacagcttcaccgactactatttgcactgggtgcgacgggcccctggacaagggcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattgggt

SEQ ID NO: 463053 - DNA, 535 bp, Homo sapiens; identical to SEQ ID NO: 462660
  misc_feature: HEFZJCU01BI1EB.7.78.H01.1.454.heavy.3.raw

SEQ ID NO: 463054 - DNA, 530 bp, Homo sapiens; identical to SEQ ID NO: 447821
  misc_feature: HEFZJCU01DIS2A.12.40.D07.1.454.heavy.3.raw

SEQ ID NO: 463055 - DNA, 492 bp, Homo sapiens; identical to SEQ ID NO: 449532
  misc_feature: HEFZJCU01E1BA9.13.71.G05.1.454.heavy.3.raw

SEQ ID NO: 463056 - DNA, 504 bp, Homo sapiens
  misc_feature: HEFZJCU01CYT92.26.80.H03.1.454.heavy.3.raw
agactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaagtgaagaagcctggggcctcagtgaaggtctcctgcaaggcttctggatacaccttcaccgcctactatatccactgggtgcggcaggcccctggacaagggcttgagtggatgggacacatcagccctaacactggtgacacaaactatgcacagagatttcagggcagggtcaccatgaccacggacacgtccataagcacagtttacatggaggtaataggctgagatctgacgacacggccgtatattaactgtgcgttattaacggacgattacgatgttttgtattggtttttacg

SEQ ID NO: 463057 - DNA, 508 bp, Homo sapiens
  misc_feature: HEFZJCU01BDSM7.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaatttttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctgcgcctgctcaggagcacctctggggcacagcggcctgggctgcctggtcaaggactacttcccatac

SEQ ID NO: 463058 - DNA, 514 bp, Homo sapiens
  misc_feature: HEFZJCU01CQAHT.49.65.F10.1.454.heavy.3.raw
agtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgaagcctctggattcaccttcaagaactttggcatgcactgggtccgccaggctccaggcacggggctggagtgggtggcagttatctcagatgatggaagtaaaaagtactattcggactccttgaagggccgattcaccatctccagagacaattccaagaacaccttgcatctacaaatgcacagtctgagacctgaggacacggctgtgtattactgtgcgaaggggggaggggatttttgcatggaccacttgactactggggccac

SEQ ID NO: 463059 - DNA, 373 bp, Homo sapiens; identical to SEQ ID NO: 445532
  misc_feature: HEFZJCU01ET069.7.37.D04.1.454.heavy.3.raw

SEQ ID NO: 463060 - DNA, 519 bp, Homo sapiens; identical to SEQ ID NO: 445330
  misc_feature: HEFZJCU01A20OO.7.78.H01.1.454.heavy.3.raw

SEQ ID NO: 463061 - DNA, 519 bp, Homo sapiens
  misc_feature: HEFZJCU01C1IZI.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctatacccacctcagtcagctggttcgacccctggggccagggaaccctggtcaccgtctcctcagcctccaccaaggcccatcggtcttcccctggcaccctcctccaagagcacctctgggggcacagcggccctgggctgcctggtcaaggactacttccgagtagtacac

SEQ ID NO: 463062 - DNA, 514 bp, Homo sapiens
  misc_feature: HEFZJCU01CPKB1.49.85.H08.1.454.heavy.3.raw
agtcgagagacacgaccggtgctcgatttagtatcactcagtcgcgggagtcgcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccaacaaccaggtggtccttacaatgaccaacatggaccctgtggacacagccacatattactgtgcacacgtcccccgccgtattattatgatgctagtggttattccaacgctgaatacttccagcacgtggggccagggcaccctgctcaccgtctcctcagcctccaccaagggcccatcggtccttcccctcggcaccctccctccaagagcacctctcgggggcacagccggccctgggctgcctggtcaaggactactcctctctcgact

SEQ ID NO: 463063 - DNA, 520 bp, Homo sapiens
  misc_feature: HEFZJCU01C9LX8.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaaattacaagaacaccctttatctgcaaatagacagcctgagaccagacgacacggctgtctattattgcgcgagagagacacacgaacctactggccaatactatggggcttgttctggggccaggggaccctggtcatcgtctccccagcctccaccaagggcccatcggtctcccctcggc

SEQ ID NO: 463064 - DNA, 523 bp, Homo sapiens
  misc_feature: HEFZJCU01BE2XN.48.81.H04.1.454.heavy.3.raw
agtatacatacacgaccggtgctcgatttagtagtgtagattcgcgggaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgagggacacggccatttactactgtgcgcggggaggtggacggagctcggttttcggagttatcatctactactttgatcttggggcccggaacccgtggtcaccg

SEQ ID NO: 463065 - DNA, 514 bp, Homo sapiens
  misc_feature: HEFZJCU01A7HH2.49.55.E11.1.454.heavy.3.raw
agtcgagagacacgaccggtgctcgatttagcactcgcacgttgggtttggggctctgggagaggagcccagcactagaagtcggcggtgtttccattcggtgatcagcactgaacacagaggactcaccatggagtttgggctgagctgggtttttcctcgttgctcttttaagaggtgtcctttgtcgggtgcagttggtggagtcggggggatctgtggtccggcctgggaagtccctgagactctcctgtactgcctccggattcaagttcgaaaattatggcttacactgggtccgccaggctccaggcaaggggctggagtgggtggcagtaatttcatatgattcaagtattggatattacgcagagtccgtaaagggccgattcaccatctccagagacaattcgaagaacaccatgtatctggaactgagcagagtcacatctgaggacacggctatgtattactgtgtgaaagacttttatgacagtagtggtttctccgagta

SEQ ID NO: 463066 - DNA, 509 bp, Homo sapiens
  misc_feature: HEFZJCU01DZ19R.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagcgtggttttcgttgttaggctatttacaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccaacctattattgtgcgcgacatgactacgctcaattctggggccagggacg

SEQ ID NO: 463067 - DNA, 501 bp, Homo sapiens
  misc_feature: HEFZJCU01DXXAZ.4.58.F03.1.454.heavy.3.raw
  modified_base (339)..(339): a, c, t, g, unknown or other
  modified_base (482)..(482): a, c, t, g, unknown or other
agcactgtagcacgaccggtgctcgatttagtctgatcgagaagggaaaggggacccaacaaccacatccctcctcagaagccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaaagccttgagtggatgggatcgatcaactctggcaatggcaacacaaaatnttcacagaagttacagggtcagagtcaccattaccagggacacatccgcgaacacagcctacatggagctgagcagcctgacatctgaagacacggctgtgtatactgttcgagacgggctagtctgggattctagtatagtnactcgtcgttctgggaccg

SEQ ID NO: 463068 - DNA, 525 bp, Homo sapiens
  misc_feature: HEFZJCU01A2ROA.47.46.E02.1.454.heavy.3.raw
  modified_base (385)..(385): a, c, t, g, unknown or other
agctcacgtacacgaccggtgctcgatttagactcatctacagggaaagggggagagaggagcccagccctgggattttcaggtgttttcatttggtgatcaggactgaaccgagagaactcaccatggagtttgggctgagctggctctttcttgtggcttttttaaaaggtgtccagtgtgaggtgcaactgttggagtctgggggagacttagtacaccctggggggtccctgagactctcctgtgcagcctctggactcacctttagcaactctgtcatgggctgggtccgccaggctccggggaagggctggagtgggtctcaagtattgatgagaatggtggaagcacattctacgtggactccgtgaagggccggttnaccatctccagagacaatttcaggagcacgctgtatctacaaatgaacagcctgagagccgaggacacggccgtatatttctgtgcgaaagtctatagcagtgccccctacgcgcactttctttgactttctggggccaa

SEQ ID NO: 463069 - DNA, 524 bp, Homo sapiens
  misc_feature: HEFZJCU01DASRR.49.81.H04.1.454.heavy.3.raw
agtcgagagacacgaccggtgctcgatttagtagtgtagattcgcggggatgggaaacactttctgagagtcctggacctcctgtgcaagaacatgaaacatctgtgggtcttccttctcctggtgacagctcccagatgggtcctgtcccaggtgcagctgcaggagtcgggcccaggactggtgaagccttcggagaccctgtccctcacctgcactgtctctggtggctccgttagtagttactattggagctgggtccggcagtcccccgggaagggactggaatggattggctatatctactacagtggaagcaccgattacaatccctcctcaagagtcgagtcagcatttcagccgacaggtccaagaaccagttctccctgaagttgaagtctgtgaccgctgcggacacggccgtgtatttctgtgcggttgatgattacctcgggggactcgatcgtactttcgacatctggggccgagggacgaacagtcatcgtctcttcaacctccaccac

SEQ ID NO: 463070 - DNA, 506 bp, Homo sapiens
  misc_feature: HEFZJCU01CRYRK.16.38.D05.1.454.heavy.3.raw
tgtactactccacgaccggtgctcgatttagtatctgatagttgggtttgggctgggagacgagcccagcactggaagtcgccggtgtttccattcggtgatcagcactgaatacagaggactcaccatggagtttgggctgagctgggttttcctcgttactcttttaagaggtgtccaatgtcaggtgcagttggtggagtctgggggaggcgtggtccagcctggaaggttcctgagactctcgtgtgcagcgtctggattcatctttaatagttttcctatgcactggatccgccaggctccaggcaggggactggagtgggtggcaggagtgtcacttgatggagccaatacatacttcgcagactccgtgaagggccgattcaccatttccagagagaattccaacaacacgctgcatctgcaaatggacaccctgagacctgacgacacggctgtctattactgtgcgaaagcaccggcagttagtcacccatacttac

SEQ ID NO: 463071 - DNA, 487 bp, Homo sapiens
  misc_feature: HEFZJCU01BMEFA.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaaggcccatcggtcttcccctggcgccctgctccaggagcacctccgagagcacagcgaccctgggctgcctggtcaggactacttcccatactcgta

SEQ ID NO: 463072 - DNA, 518 bp, Homo sapiens
  misc_feature: HEFZJCU01BHCUU.2.85.H08.1.454.heavy.3.raw
acgctcgacacacgaccggtgctcgatttagtatcactcagtcgcggggccctgggagcacagctcatcaccatggactggacctggaggttcctctttgtggtggcagcagctacaggtgtccagtcccaggtccagctggtgcagtctggggctgaggtgaagaagcctgggtcctcggtgagggtctcctgcaaggcttctggaggcaccttcaggacctatattatgacctgggtgcgacaggcccctggacaagggcttgagtggctgggggggatcatccctatgtttggtgaagcaaattacgcacagaagttccggggaagagtctcgattaccgcggacgaatccacgaacacagcctacatggaagtgaccagcctgagatctgaagacacggccgtgtattactgtgcgaagtcgtattactatgatactggtgattatttgaatttcgactcctaccactacggtatggacgtctggggccaggggaccacggtcaccgtctcttc

SEQ ID NO: 463073 - DNA, 508 bp, Homo sapiens
  misc_feature: HEFZJCU01EXRVI.48.44.D11.1.454.heavy.3.raw
agtatacatacacgaccggtgctcgatttagcgcagtacgaagggaggcttggtccagcctgggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctgggtcaaggactacttcctatgtatact

SEQ ID NO: 463074 - DNA, 522 bp, Homo sapiens
  misc_feature: HEFZJCU01CPA1D.40.33.C11.1.454.heavy.3.raw
tctagcgactcacgaccggtgctcgatttagagtgagctcgttgggtttgggggagccccagccctgggattcccagctgtttctgcttgctgatcaggactgcacacagagaactcaccatggagcttgggctgagctgggttttccttgttgctattttaaaaggtgtccagtgtgaggtgcagttggtggagtccgggggaggcttagttcagcctggggggtccctgagactctcctgtgcagcctctggagtcactctctccgcctactgggtactctgggtccgccaagctccagggaagggctggagtgggtcgcacgtatttataaagatggatccacagcgtacgcggactccgtgaagggccgattcaccatctccagagacaacgccaagaacacagtgtctctgcaaatggacagtctgagagccgaggacacgggtgtctattattgtacaaaagtggggactaatgaatatggtgtggacgtctggggccaagggaccacggtcgtcg

SEQ ID NO: 463075 - DNA, 528 bp, Homo sapiens
  misc_feature: HEFZJCU01DMJET.48.78.H01.1.454.heavy.3.raw
agtatacatacacgaccggtgctcgatttagtgtgagtagtttgggtttgggtgccgaagttgctggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggactacttcctatgtatact

SEQ ID NO: 463076 - DNA, 512 bp, Homo sapiens
  misc_feature: HEFZJCU01ASO5H.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctgcgatctgacgacgcggccgtatattactgtgtgagagtacgtagcggctcgtcctttgactactggggcctgggaactctggtcacgtct

SEQ ID NO: 463077 - DNA, 535 bp, Homo sapiens
  misc_feature: HEFZJCU01D2D3B.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaagggctggagtgggttggccgtattaaaaccaaactgatggtgggacaacagactacgctgcacccgtgaaaggcagattcaccatctcaagagatgattcaaaaagcacgctgtatctgcaaatgaacaagcctgagaaccgaggacacagccgtgtattactgtaccacatcccctgaaagcgtcaactactactactacggtatggacctctgggaccg

SEQ ID NO: 463078 - DNA, 539 bp, Homo sapiens
  misc_feature: HEFZJCU01DXMQY.48.14.B03.1.454.heavy.3.raw
agtatacatacacgaccggtgctcgatttagtgtgagtagttccgcgggggtctcagagaggagccttagccctggactccaaggcctttccacttggtgatcagcactgagcacagaggactcaccatggaattggggctgatctgggttttccttgttgctctttttggaggtgtccactgtgaggtgcaactggtggaatctgggggaggcttggtccagcctgggggctctctcagactctcctgtgaaacctctggattcacctttacgactttttggatgggttgggtccgccaggccccagggaaggggctgcagtgggtggccaacacaaatcaaaatggaaacgtggagtactatgcggagtctgtgaagggccggttcaccatctacagagacaacggcaagaagtcgctgtttctgcaaatgaacagcctgacctccgacgacacggctctctattattgtgtgagagaatcctgggggaccggccgtcttcgggggccaggggaacactggttatcgtctcttcacg

SEQ ID NO: 463079 - DNA, 530 bp, Homo sapiens
  misc_feature: HEFZJCU01CR1QC.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagtttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctgggtcaccggtctccccaccctccaccg

SEQ ID NO: 463080 - DNA, 519 bp, Homo sapiens; identical to SEQ ID NO: 445330
  misc_feature: HEFZJCU01EEOZQ.7.78.H01.1.454.heavy.3.raw

SEQ ID NO: 463081 - DNA, 490 bp, Homo sapiens
  misc_feature: HEFZJCU01BT82F.48.73.G07.1.454.heavy.3.raw
  modified_base (435)..(435): a, c, t, g, unknown or other
  modified_base (483)..(483): a, c, t, g, unknown or other
agtatacatacacgaccggtgctcgatttagctctacgctcaggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagccccagggaaggggctggagtggattgggagtatttaccacagtgggagcacctactacaacccgtccctcaaaagtcgaggcaccatatccgtagacacgtccaagaaccaattctccctgaagctgagctctgtcgaccgccgcagacacggctgtctattactgtgcgnggcccgagcgcagtggcttttgatgctttgatatgtgggcagggcaanggtcacg

SEQ ID NO: 463082 - DNA, 521 bp, Homo sapiens; identical to SEQ ID NO: 445317
  misc_feature: HEFZJCU01CBYCM.12.40.D07.1.454.heavy.3.raw

SEQ ID NO: 463083 - DNA, 518 bp, Homo sapiens
  misc_feature: HEFZJCU01DBWLG.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcggagcaccaactacaacccgtccctcaagagtcgagttaccatttcattaaacacgtctaagaaccagttctccctgaagctgacctttgtgactgccgcggacacggccgtgtattactgtgcgagagacccctcgatagcagtggctggtccactaggtttgactactggggccagggaagcttggtcaccgtctcctcagcct

SEQ ID NO: 463084 - DNA, 487 bp, Homo sapiens
  misc_feature: HEFZJCU01C0MBZ.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgcctgctccaggagcacctccgagagcacagcggccctgggctgcctggtcaaggactacttccatactcgta

SEQ ID NO: 463085 - DNA, 515 bp, Homo sapiens
  misc_feature: HEFZJCU01EYDB2.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccaagggacaatggtcaccgtctcttcagcctccaccaagggcccatcggtcttcccctggcgccctgctccaggagcacctccgagagcacagcggccctgggctgcctggtcaaggactacttccagacgta

SEQ ID NO: 463086 - DNA, 535 bp, Homo sapiens; identical to SEQ ID NO: 457991
  misc_feature: HEFZJCU01D8AIJ.17.28.C06.1.454.heavy.3.raw

SEQ ID NO: 463087 - DNA, 519 bp, Homo sapiens
  misc_feature: HEFZJCU01BF3VY.53.27.C05.1.454.heavy.3.raw
cgcgtatacacacgaccggtgctcgatttagacgcgatcgaagggtttgggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttggtccagcctggggggtccctgagactctcctgtgcagcctctggattgaccgtcagtagcaactacatgagctgggtccgccaggccccagggaaggggctggagtgggtctcaacaatttatagcggtggtaggacataccacgcagaccccgtgaagggccgattcaccatctccagacacaattccaagaacacactgtttcttcaaatggacttcctgagaactgaggacacggccgtgtattactgcgcgagagtgcatgatagtggtttccatgatgcttttgatgtctggggtaccg

SEQ ID NO: 463088 - DNA, 437 bp, Homo sapiens
  misc_feature: HEFZJCU01B82X9.40.27.C05.1.454.heavy.3.raw
tctagcgactcacgaccggtgctcgatttagacgcgatcgaagggtttggggctgggtccgccggcccccagggaaggggctggagtggattgcgagcatatattatgatgagagcgccctctacaaccccccccctctacaacccctccctcaagagtcgggtcaccatatctatagacacgtccaacagtcaattctccctggacttgacctctgtgaccgccgcagacacggctgtatattcctgtgcgaccccacggaggggatggccccaaatctgcctactttgaccactggggccagggaaccttggtcaccgtctcctcagcctccaccaagggcccatcggtcttcccctggcgccctgctccaggagcacctccgagagcacagcggccctgggctgcctggtcaaggactacttccagtcgctaga

SEQ ID NO: 463089 - DNA, 466 bp, Homo sapiens; identical to SEQ ID NO: 445835
  misc_feature: HEFZJCU01BZE1Z.9.34.D01.1.454.heavy.3.raw

SEQ ID NO: 463090 - DNA, 522 bp, Homo sapiens
  misc_feature: HEFZJCU01AS2OM.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggtcgattcaccatctccagagacaattacaagaacaccctttatctgcaaatagacagcctgagaccagacgacacggctgtctattattgcgcgagagagacacacgaacctactggccaatactatgggggcttgttctgggggccaggggaccctggtcatcgtctccccagcctccaccaagggcccatcggtcttcccctggcg

SEQ ID NO: 463091 - DNA, 510 bp, Homo sapiens; identical to SEQ ID NO: 445542
  misc_feature: HEFZJCU01EB501.16.21.B10.1.454.heavy.3.raw

SEQ ID NO: 463092 - DNA, 523 bp, Homo sapiens
  misc_feature: HEFZJCU01B9PBI.52.55.E11.1.454.heavy.3.raw
cgcagtacgacacgaccggtgctcgatttagcactcgcacgttgggtttgggagaggagcccagcactgggattccgaggtgtttccattcagtgatctgcactgaacacagaggactcgccatggagtttgggctgagctgggttttccttgttgctattttaaaaggtgtccagtgtggagtgcaggtggtggagtctgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccaggggggcgggagcagccccgtaacttcgtggggccaggggtaaccc

SEQ ID NO: 463093 - DNA, 530 bp, Homo sapiens; identical to SEQ ID NO: 456327
  misc_feature: HEFZJCU01DBW1H.17.34.D01.1.454.heavy.3.raw

SEQ ID NO: 463094 - DNA, 494 bp, Homo sapiens
  misc_feature: HEFZJCU01BPBKW.14.25.C03.1.454.heavy.3.raw
cgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccatcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattg

SEQ ID NO: 463095 - DNA, 491 bp, Homo sapiens; identical to SEQ ID NO: 447010
  misc_feature: HEFZJCU01CCLF5.4.7.A07.1.454.heavy.3.raw

SEQ ID NO: 463096 - DNA, 518 bp, Homo sapiens
  misc_feature: HEFZJCU01EHUCC.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaagggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataaccgttcgcctggttattacc

SEQ ID NO: 463097 - DNA, 525 bp, Homo sapiens; identical to SEQ ID NO: 450208
  misc_feature: HEFZJCU01C7CP1.3.82.H05.1.454.heavy.3.raw

SEQ ID NO: 463098 - DNA, 533 bp, Homo sapiens
  misc_feature: HEFZJCU01ENCHO.18.59.F04.1.454.heavy.3.raw
tacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacactccctgaaagcgtcaactactactactacggtatggacctcg

SEQ ID NO: 463099 - DNA, 513 bp, Homo sapiens
  misc_feature: HEFZJCU01EZ0G2.48.35.D02.1.454.heavy.3.raw
agtatacatacacgaccggtgctcgatttagcacacgatagttgggtttgggggagccttggtgcagcctggagagtccctaagactctcctgcgcagcctcaggattcagtttcagtagttatgaaatgaattgggtccgccaggctccagggaagggactggagtggctttcatatattactggcagtgggtctcttacccattatgcagactctgtgaggggccgattcaccatctccagagacaacccccgaaactctctttttctgcaaatggacagcctgacagccgacgatacggccatttattactgtgcgagagatgggaccccccgcatatccagaaggcacactctactttgacctctggggccaggggatcctggtcaccgtctcctcagcctccaccaagggcccatcggtcttcccctggccgccctgctccaggagccacctccgagagcacagcggccctgggctcgcctggtcaaggactacttcctatgtatact

SEQ ID NO: 463100 - DNA, 506 bp, Homo sapiens
  misc_feature: HEFZJCU01AJFRN.11.6.A06.1.454.heavy.3.raw
cgagagataccacgaccggtgctcgatttagatctactgacagggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtctgggggaggcttggtaaagccgggggggtcccttagactctcctgtgcagcctctggcatcactttcagtgacgcctggatgagctgggtccgccaggctccagggaaggggctggagtgggttggccgtattaaaagcgaggctgctggtgggacaacagactacgctgcacccgtgaagggcagattcaccatctccagagatgattcaaggagcacagtgtttctacaaatgaacagcctgactgccggggacactgccgtgtattactgtgccagcagcagcacctggccactatatttctttcg

SEQ ID NO: 463101 - DNA, 500 bp, Homo sapiens
  misc_feature: HEFZJCU01CK4UN.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttcccctggcgccctgctccaggagcacctccgagagcacagcggccctgggctgcctggtcaaggactactccacta

SEQ ID NO: 463102 - DNA, 485 bp, Homo sapiens
  misc_feature: HEFZJCU01C4EJQ.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggagcgtggcccagcctgggaggtccctcagactctcctgtgcagcgtctggattcagtttcgctacacatggcatgcactggtccgccagtctccaggcaaggggctgcagtgggtggcgtttattcgaagcgatgggactcatgaacaatatgcagactccgtgaagggccgattcatcatctccagagacaactccaacaacacactggatctccaaatgaacagcctgagagtcgaggacacggccgtatattattgtgcccttgattacta

SEQ ID NO: 463103 - DNA, 518 bp, Homo sapiens
  misc_feature: HEFZJCU01A907A.47.55.E11.1.454.heavy.3.raw
agctcacgtacacgaccggtgctcgatttagcactcgcacgttgggtttgggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgcctttcggtccgcggggacttctgggggccaggggtaaccccg

SEQ ID NO: 463104 - DNA, 505 bp, Homo sapiens
  misc_feature: HEFZJCU01AKYKH.11.72.G06.1.454.heavy.3.raw
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcacactggaagcagagtctatgcggagagattccagggcagagtcaccctgaccacagagacatccacgaccacagtctacatggagctgtggagcctgagacctgacgacacggccctctattactgtgcgaggccctatcctacagtgaccactccacgctggttcgacctctgggccac

SEQ ID NO: 463105 - DNA, 537 bp, Homo sapiens
  misc_feature: HEFZJCU01AN2OK.13.28.C06.1.454.heavy.3.raw
tcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagcctggggggtccctgagactctcctgtgtagcctctggatttgtttttagtgactattggatgagttgggtccgccaggctccagggaaggggctggagtgggtggccaacataaagtacgatgaagttgagataaattatttggactctgtgaagggccgattcaccatctcgagggacaacgccaagaactcgctgtatctgcaaatggagagcctgagagccgaggacacggctgtatattattgtgtgagattagcgcacttactttgactacgtggggccaggggaacccttgggtccaccggtt

SEQ ID NO: 463106 - DNA, 478 bp, Homo sapiens
  misc_feature: HEFZJCU01C2ZUB.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggccctggacaagggcttgagtggatgggatggatcgaccctaacagcggtggcacaaagtatgcacagaagtttcagggcagggtcaccatgaccagggacacgtccatcagcacgtccatcagcacagcctacatggacctgagcggcctgacatctgacgacacggccgtatatttctgtgcgaggg

SEQ ID NO: 463107 - DNA, 400 bp, Homo sapiens; identical to SEQ ID NO: 444452
  misc_feature: HEFZJCU01CPMP1.47.24.C02.1.454.heavy.3.raw

SEQ ID NO: 463108 - DNA, 475 bp, Homo sapiens; identical to SEQ ID NO: 451354
  misc_feature: HEFZJCU01D5SHQ.16.10.A10.1.454.heavy.3.raw

SEQ ID NO: 463109 - DNA, 507 bp, Homo sapiens
  misc_feature: HEFZJCU01BJLMN.43.82.H05.1.454.heavy.3.raw
tgtgagtagtcacgaccggtgctcgatttagtcgagctctctcgcggggatccaacaaccacatcccttctctacagaagcctctgagaggaaagttcttcaccatggactggacctggagggtcctctgcttgctggctgtagctccaggtggtcactcccaggtgcaactggtgcagtctggggctgaggtgaagaagccgggggcctcagtgaaggtttcctgcagggcatctggatacaccttcaccgagtactatatacactgggtgcgacaggccccgggacaagggcttgagtggatggggacaatcagccctagcgctgataccacaacctacgcacagaagttccagggcagagtcaccatgtccattgacacgtccacgagcacagtgaatatggagttggagcagcctcaggtctgaggacacgggccgtctattactgtagtcaacaactgagggcctggggccaggggaaccctgggtccgccgtctcctcacg

SEQ ID NO: 463110 - DNA, 538 bp, Homo sapiens
  misc_feature: HEFZJCU01COHXI.4.25.C03.1.454.heavy.3.raw
agcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgtttctgcaaatgaacagcctgagagccgaggacacggctgtgtatcactgtgtcagagatgccgagggcggttacccctctggtttccttcgacagttatgggtatggacgtctgggggcctagggactacgggtcacccgttctccttccagccctccacccaaggggaccccacgtacggttccctttcccccttcggaccg

SEQ ID NO: 463111 - DNA, 517 bp, Homo sapiens
  misc_feature: HEFZJCU01DJ4RU.10.53.E09.1.454.heavy.3.raw
catagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgttctgcaaatgaacagcctgagagctgaggacacggctgtgtattactgttcgtttggttctgactcgtcgggggaataccttcagcactggggccgac

SEQ ID NO: 463112 - DNA, 508 bp, Homo sapiens
  misc_feature: HEFZJCU01CX9T7.21.4.A04.1.454.heavy.3.raw
tcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctctgcattcaccttcagtgaccacaacatggactgggtccgccaggctccagggaagggctggagtgggtcggccgtattacaaggaaagctaacagttacagtacagaatacggcgcgtctgtgaaaggaaggttcaccatctcaagagatgattcaaaagaactcactgtatctgcaaatgaacagcctagaaaccgaggacacggccgtgtattattgtggtagacaaaagagtggatgtggtggtagct

SEQ ID NO: 463113 - DNA, 502 bp, Homo sapiens; identical to SEQ ID NO: 455722
  misc_feature: HEFZJCU01BPHJJ.3.20.B09.1.454.heavy.3.raw

SEQ ID NO: 463114 - DNA, 538 bp, Homo sapiens
  misc_feature: HEFZJCU01ENGXT.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggctttttcttgtggctttttaaaaggtgcccagtgtgaggtgcaactgttggagtctgggggaggcttggtacagccggggggtccctgagactctcctgtgcagcctctggattcaattttaacagctttgccatgggctgggtccgccaggctccagggaagggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattactgtgcgaaggatcgccctataatggtggctggatcggggagtttggttcctggggccagggaaccctggtcc

SEQ ID NO: 463115 - DNA, 519 bp, Homo sapiens
  misc_feature: HEFZJCU01A1MWH.13.25.C03.1.454.heavy.3.raw
tcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacagtccggggctgaggtgaagaagcctgaggcctcagtgaaggtctcctgcaaggcttccggatacaccctcaatggaaactatgtccactatgtgcgacaggccccaggacaagggcttctgtggatggggtggatcaaccctaatagtggtgacacaaactatgagaagaaatttgagggccgggtcaccatgaccagggacacgtccatcaatacagccttcatggaactgaccagactgacctctgacgacacggccgtgtattactgtgcggtcgaaactcagcctaactactttgaattttggggccagggagccctggtcaccgt

SEQ ID NO: 463116 - DNA, 534 bp, Homo sapiens
  misc_feature: HEFZJCU01CI5E2.17.28.C06.1.454.heavy.3.raw
  modified_base (522)..(522): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggcctttcaccatctccagagacaacgccaagaattcactgtatctacaactgaacagcctgagagtcgcagacacggccgtgtattactgtgcgagatgtggaaaaagtatggctgtgtttagttggggccaggganccctggtcaccg

SEQ ID NO: 463117 - DNA, 521 bp, Homo sapiens
  misc_feature: HEFZJCU01B15M3.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctgggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggttctacttcgatctcgtc

SEQ ID NO: 463118 - DNA, 493 bp, Homo sapiens
  misc_feature: HEFZJCU01CD2P6.52.35.D02.1.454.heavy.3.raw
cgcagtacgacacgaccggtgctcgatttagcacacgatagttgggtttggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcggagcagccccgtaacttctggggccagggaacccgggtcaccgtctcctcagcctccaccaagggcccatcggtcttccccctggcaccctcctccaagagcacctctgggggcacagcggccctgggctgcctggtcaaggactacttcctatacgatcg

SEQ ID NO: 463119 - DNA, 503 bp, Homo sapiens
  misc_feature: HEFZJCU01ASEEQ.48.59.F04.1.454.heavy.3.raw
agtatacatacacgaccggtgctcgatttagtacacacacttagggattggggtctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgattatgtggggccaagggacaatggtcaccgtctt

SEQ ID NO: 463120 - DNA, 538 bp, Homo sapiens
  misc_feature: HEFZJCU01DCQVC.53.78.H01.1.454.heavy.3.raw
cgcgtatacacacgaccggtgctcgatttagtgtgagtagtttgggtttgggctcaactcccaggtccagttggtgcagtctggggctgagttgaagaagcctgggtcctcggtgaaggtctcctgcaagtattctggaggcaccttcaacaactatggtatcagctgggtgcgacaggcccctggacaagggcttgagtggatgggaagggtcacccctatttttgatgaagcagactctgcacagaagttccagggcagattaacgattacggcggacaagtccacgactaccgcctacatggagctgaccagtctgaaatctgaggacacggccctttattactgtgcgagatataccgtgggggttacggcggagatatcgccatactacttcgactactggggccagggaaccctgatcaccgtctcctcagcctccaccaacgggcccactcggtcttcccccttcggccaccctcctcccaagagcacctctgggggcacagcggcctgggctgcctggtcaggactactt

SEQ ID NO: 463121 - DNA, 514 bp, Homo sapiens
  misc_feature: HEFZJCU01EO03J.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgtgctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgcctttcggtccgcgggacgttcgtggggccagggtaacccg

SEQ ID NO: 463122 - DNA, 477 bp, Homo sapiens
  misc_feature: HEFZJCU01CC8P8.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccttggcaccctcctccaagagcacctctgggggcacagcggccctgggctgcctggtcaaggactacttccgagtagtaca

SEQ ID NO: 463123 - DNA, 513 bp, Homo sapiens
  misc_feature: HEFZJCU01AZHXU.48.19.B08.1.454.heavy.3.raw
agtatacatacacgaccggtgctcgatttagtgagtcagtaagggggctttctgagagtcatggatctcatgtgcaagaaaatgaagcacctgtggttcttcctcctcctggtggcggctcccagatgggtcctgtcccagctgcagctgcaggagtcgggcccaggactggtgaagccttcggagaccctgtccctcacctgcactgtctctggtgactccatcagcagtagtacttactactggggctggatccgccagcccccagggaaggggctggagtggattgggagtatctattatagtgggagtacctactacaacccgtccctcaagagtcgactcaccatatccgtagacacgtccaagaaccagttctccctgaagctgagctctgtgaccgccgcagacacggctgtgtattactgtgcggagggggccggatattgttatagaaccacctgctatctgagctggttcgactgctggggccagggaaccctggtcctaccg

SEQ ID NO: 463124 - DNA, 395 bp, Homo sapiens; identical to SEQ ID NO: 444494
  misc_feature: HEFZJCU01CYGAQ.47.46.E02.1.454.heavy.3.raw

SEQ ID NO: 463125 - DNA, 522 bp, Homo sapiens
  misc_feature: HEFZJCU01D0TEC.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatgggtctcagttattcataccgacggtaccatatatgacgcagactccgtgaagggccgattcaccatctccagagaccattccaagaacaccctatatcttcaaatgaacaacctgagagtcgaagacacggccgtatattactgtgcgagacatgacttcggtgaccccgtggggccacgggaacccgtggtcaccgtcctcctca

SEQ ID NO: 463126 - DNA, 518 bp, Homo sapiens
  misc_feature: HEFZJCU01AUNXS.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcgccctgctccaggagcacctccgagagcacagcggcctgggctgcctggtcaaggactacttccagacgtatcac

SEQ ID NO: 463127 - DNA, 511 bp, Homo sapiens
  misc_feature: HEFZJCU01DM0RE.48.73.G07.1.454.heavy.3.raw
agtatacatacacgaccggtgctcgatttagctctacgctcctgctgctgaccatcccttcatgggtcttgtcccagatcaccttgaaggagtctggtcctacgctggtgaaacccacacagaccctcacactgacctgcaccttctcgggcttctcactcactcgtagtggggaggctgtggcctggattcgtcagcccccagggaaggccctggagtggcttgctctcatttactgggatactgatgaccgctacactccagctctgaaaaacaggctcaccatcgccatggacacctccaaaaaacaggtggtccttaaaatgaccaacatggacccaatggacagcgcgacatattactgtgcacacattgattgtggtcccaccaggtgtcccgggccctttgatatctggggccgggggacattcgtcaccgtctctgcagcctccaccaagggcccatcggtcttcccctggcgccctgctccaggagcacctccgagagcacg

SEQ ID NO: 463128 - DNA, 490 bp, Homo sapiens
  misc_feature: HEFZJCU01DFJZP.11.38.D05.1.454.heavy.3.raw
cgagagataccacgaccggtgctcgatttagtatctgatagttgggtctgggggaggcttggtacagcctggggggtccctgagactctcctgtgcagcgtctggattcacctttagcagctatgccatgacctgggtccgccaggctccagggaagggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagtggtggtagctgctactggggccagggaaccctggtcaccgtctcctcagcctccaccaagggcccatcggtcttcccctggcaccctcctccaagagcacctctgggggcacagcggccctgggctgcctggtcaaggactacttccgtatctctcg

SEQ ID NO: 463129 - DNA, 504 bp, Homo sapiens
  misc_feature: HEFZJCU01C6ZTY.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgaggctgtgagcgccgcagacacggccgtgtattactgtgcgagactggcccgcaaccgagactacgggtggccaactcctatgcttttgatatctggggccaagggac

SEQ ID NO: 463130 - DNA, 502 bp, Homo sapiens
  misc_feature: HEFZJCU01D2NJE.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaagggctggagtgggtctcagttattgaaacagatggcactacatattattctgactccgtgaagggccggttcaccctctccagagacacttccaacaacatcttgtatcttcacatgcacaatctgagagtcgacgacacggccacctatattgtgcgcgacatgactacgctcaattctgggccaggagcccaggtcaccgtctccccagcctccaccaagggcccatcggtcttccccctggcgccctgctccaggagcacctccgagagcacagcggccctgggctgcctggtcaaggactacttcccactacta

SEQ ID NO: 463131 - DNA, 511 bp, Homo sapiens
  misc_feature: HEFZJCU01ERKSF.49.38.D05.1.454.heavy.3.raw
agtcgagagacacgaccggtgctcgatttagtatctgatagttgggtttggggggaagaggaagactgacggtcctcccaggagttcaggtgctgggcaccgtgggcatgggggaggcgtggtccagcctgggaggtccctgagactctcctgtgcagcctctggattcgtctctagtgtctaccctatgcattgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctcggggccagggacgccctggtcacccgtctcctcagcttccaccagggcccatcggtcttcccctggccgcctcgctccagga

SEQ ID NO: 463132 - DNA, 507 bp, Homo sapiens
  misc_feature: HEFZJCU01DRXS6.13.37.D04.1.454.heavy.3.raw
tcacgtactacacgaccggtgctcgatttagtagcatactgttgggtttgggggaggcttggttcagcctggggggtccctgagactctcgtgtgcagcctctggatttagttttagcagttatgccatgagtctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattgtaatgatggtagctgctactacactttttgactactggggccagggaaccctggtcaccgtctcttcagcctccaccaagggcccatcggtcttcccctggcaccctcctccaagagcacctctgggggcacagcggccctgggctgcctggtcaaggactacttcctagtacgtga

SEQ ID NO: 463133 - DNA, 518 bp, Homo sapiens; identical to SEQ ID NO: 458834
  misc_feature: HEFZJCU01COOHK.9.43.D10.1.454.heavy.3.raw

SEQ ID NO: 463134 - DNA, 499 bp, Homo sapiens
  misc_feature: HEFZJCU01CPX5G.14.55.E11.1.454.heavy.3.raw
cgtctagtaccacgaccggtgctcgatttagcactcgcacgttgggtttggggctgggagaggagcccagcactagaagtcggcggtgtttccattcggtgatcagcactgaacacagaggactcaccatggagtttgggctgagctgggtttctcgttgctcttttaagaggtgtccagtgtcaggtgcagctggtggagtctgggggaggcgtggtccagcctgggaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgtattactgtgtcagagatgggaggggggtggtgatcc

SEQ ID NO: 463135 - DNA, 524 bp, Homo sapiens
  misc_feature: HEFZJCU01BAZ89.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgtctggggccaggggacctggtcatcgtctccccagcctccaccaagggcccatcggtcttcccctggcgcctcg

SEQ ID NO: 463136 - DNA, 508 bp, Homo sapiens
  misc_feature: HEFZJCU01DF5VT.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacgggcagtgtattactgtgcgagagatcgacatgactacgggaaagcttttgatctctggggccaagggacactggtcaccgtctcttcagcctccaccaagggcccatcggtcttcccctggcgccctgctccaggacg

SEQ ID NO: 463137 - DNA, 400 bp, Homo sapiens; identical to SEQ ID NO: 444452
  misc_feature: HEFZJCU01D0E0C.47.24.C02.1.454.heavy.3.raw

SEQ ID NO: 463138 - DNA, 491 bp, Homo sapiens
  misc_feature: HEFZJCU01AVOQ1.19.53.E09.1.454.heavy.3.raw
tactctcgtgcacgaccggtgctcgatttagagagagtgtgttgggtttggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagcggcccgtggctcgcctggtcaaggactacttcccacgagagta

SEQ ID NO: 463139 - DNA, 528 bp, Homo sapiens
  misc_feature: HEFZJCU01CLG5Y.5.33.C11.1.454.heavy.3.raw
atcagacacgcacgaccggtgctcgatttagagtgagctcgttgggtttgggggaggcttggtccagcctggggggtccctgagactctcctgtgtagcctccggattcacctttagtgcctattggatgacctgggtccgccaggctccagggaaggggctggagtgggtggccaatataagattcgatggaagtgaggtgtactatgtggactctgtgaagggccgattcaccatctccagagacaacgccgagaactcactgtatctccaaatgaacagcctgagagccgaggacacggctgtctactactgtacgaatatcccctcgttttacgatttttggactggcccgttggggtactcctacggtttggacgtctgggccaagggaccacggtcaccgtctcctcagcctccaccaagggcccatcggtcttccccctggcgccctcgctccaggagcacctccgagagcacagcggcccgtgggcgtgccgtggtcaaggactacttcccgtgtctgat

SEQ ID NO: 463140 - DNA, 488 bp, Homo sapiens
  misc_feature: HEFZJCU01EO6UQ.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagccacctccgagagcacagcggccctggctgcctggtcaagactacttcctacgtgagct

SEQ ID NO: 463141 - DNA, 379 bp, Homo sapiens; identical to SEQ ID NO: 444450
  misc_feature: HEFZJCU01CW34C.47.77.G11.1.454.heavy.3.raw

SEQ ID NO: 463142 - DNA, 527 bp, Homo sapiens
  misc_feature: HEFZJCU01DBZGJ.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgactctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctgggctgcctggtcaaggactacttccacg

SEQ ID NO: 463143 - DNA, 518 bp, Homo sapiens
  misc_feature: HEFZJCU01CB1FE.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacggaacgttactacgctatggacgtcgtgggggaccg

SEQ ID NO: 463144 - DNA, 513 bp, Homo sapiens
  misc_feature: HEFZJCU01C49MK.52.28.C06.1.454.heavy.3.raw
cgcagtacgacacgaccggtgctcgatttagagctcacgtattgggtttggggagctctgggagaggagcccagcactgggattccgaggtgtttccattcagtgatctgcactgaacacagaggactcgccatggagtttgggctgagctgggttttccttgttgctattttaaaaggtgtccagtgtggagtgcaggtggtggagtctgggggaggcttggtccagcctggtggttccctgagactctcctgtgcagcctctggattctccgtcagtagcaactacatgagctgggtccgccaggctccagggaagggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttcg

SEQ ID NO: 463145 - DNA, 497 bp, Homo sapiens
  misc_feature: HEFZJCU01DKHIJ.52.38.D05.1.454.heavy.3.raw
cgcagtacgacacgaccggtgctcgatttagtatctgatagttgggtttgggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctggggggggcgtggtccagcctgggaggtccctgagactctcctgtgcaggctctgcatttcccttcagtaactatgctatcgattgggtccgccaggctccaggcaagggactggagtgggtggcagttatatcagctgatggaggcagtaaatattacgcagattctgcgaggggccgattcaccatatccagagacaactcccaagatatgatatatctacaaatgaacagcctgagacctgaggacacggctgtatattattgtgcgtcgagggggcaggtgccg

SEQ ID NO: 463146 - DNA, 508 bp, Homo sapiens
  misc_feature: HEFZJCU01DVNG8.19.26.C04.1.454.heavy.3.raw
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctggggccaagggaccacgggtcatcgtctccccagccctccaccaagggcccatcggtcttccccctggcgccctgctcca

SEQ ID NO: 463147 - DNA, 521 bp, Homo sapiens
  misc_feature: HEFZJCU01EUQ63.47.64.F09.1.454.heavy.3.raw
agctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcaccagttttaattattggtggggctggatccgccagcccccagggaaggggctggaatggattgggagtatattttataatggggacactctttacaacccatccctcaagagtcgagtttccatatccgcagacacgtccgagaatcacttctccctgaaactgagctctgtgaccgccgcagacacggctgtttattactgttcgagacatgccgaccgagagcattatcggcagtacggttttgattatttggggccaagggacaagggtcaccgtctccgcagcctccaccg

SEQ ID NO: 463148 - DNA, 522 bp, Homo sapiens
  misc_feature: HEFZJCU01AN1G1.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttcccctggccg

SEQ ID NO: 463149 - DNA, 524 bp, Homo sapiens
  misc_feature: HEFZJCU01EY7NI.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctggggccaaggtacagcggtcaccgtcgcctcacgcctccaccaacgggcccatccggtcttccccctggcaccctcctccaagagcacctctgggggccacac

SEQ ID NO: 463150 - DNA, 504 bp, Homo sapiens
  misc_feature: HEFZJCU01CJ7DM.51.40.D07.1.454.heavy.3.raw
cgatcgtatacacgaccggtgctcgatttagtgatagagcgtaacaacagaggggagctctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtctgggggaggcgtggtccagcctgggaggtccctgagactctcctgtgtagtctctggattcaccttcagggtgtacgacatgcactgggtccgccaggctccaggcaaggggctggagtgggtggcatttatatcacatgatggaagtaaaacatactatgcagagtccgtgaagggccgattcaccatctccagagacaattccaagaacacactgtttctgcacatgaaaagcctgagagctgaggacacggctgtttattactgtgcggaacttaatcacggaggaaccg

SEQ ID NO: 463151 - DNA, 518 bp, Homo sapiens
  misc_feature: HEFZJCU01DEK5V.10.85.H08.1.454.heavy.3.raw
catagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaaagaagtcactgtatctgcaaatgaacgatgtgagagtcgaggacacggctgtatatttctgtgcgaggggagccggctagtggttcggacctcgtggggccaggggaccc

SEQ ID NO: 463152 - DNA, 508 bp, Homo sapiens
  misc_feature: HEFZJCU01AF8FJ.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccaggagacaattccaagaatacgctgtatctgcaaatgaacagcctgagagtcgaggacacggccgtatattattgtgcgaaagacgtatgtagtggtgactgcttgtttggagctttttgactactggggccagggaaccctggtcatcgtctcctcagcctccaccaagggcccatcggtcttcccctggcaccctcctccaagagcacctctgggggcacagcggccctgggctgcctggtcaaggactacttccgagtagtaca

SEQ ID NO: 463153 - DNA, 479 bp, Homo sapiens
  misc_feature: HEFZJCU01CWFJC.4.37.D04.1.454.heavy.3.raw
agcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagcacagcctacatggacctgagcggcctgacatctgacgacacggccgtatatttctgtgcgagggag

SEQ ID NO: 463154 - DNA, 468 bp, Homo sapiens
  misc_feature: HEFZJCU01CGLSO.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggcccatcggtcttcccctggcgccctgctccaggagcacctccgagagcacagcggccctgggctgcctggtcaaggatacttcctacagtgct

SEQ ID NO: 463155 - DNA, 490 bp, Homo sapiens
  misc_feature: HEFZJCU01C9UHX.16.67.G01.1.454.heavy.3.raw
tgtactactccacgaccggtgctcgatttagagtatacatattgggtccctgagactctcctgtgcgacctctggattcacctttagcagctatgccatgagctgggtccgccaggctccagggaaggggctggagtgggtctcaactattagtggtagtggtggtaccacatacttcgctgactccgtgaagggccggttctccatctccagagacacttccaagaacacggtgtatctgcaagtgcacagcctgagagccgaggacacggccatatattactgtgcgaaagatcgattccccctccgtacgagatggctcaaaaaatctttctccgaattgacttctggggccagggaaccctggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 463156 - DNA, 521 bp, Homo sapiens
  misc_feature: HEFZJCU01BD593.4.35.D02.1.454.heavy.3.raw
agcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtggctccatcagtaatttgtactggagctggatccggcagtcccaagggaagggactggagtgggttggatatatctttcacaccgggaccaccaactacaatccctccctcaagagtcgactcaccatgtcactggacacttccaagaaccagttctccctaaaattgacctctgtgagcgctgcagacacggccgtctattactgtgcgagactgcggggctattatggttcgggagatcccagtggttttgatatatggggccaggggacagcggtcaccggtctcttcagcctcc

SEQ ID NO: 463157 - DNA, 518 bp, Homo sapiens; identical to SEQ ID NO: 450369
  misc_feature: HEFZJCU01ED4ZZ.7.78.H01.1.454.heavy.3.raw

SEQ ID NO: 463158 - DNA, 371 bp, Homo sapiens; identical to SEQ ID NO: 444435
  misc_feature: HEFZJCU01DGMI6.3.42.D09.1.454.heavy.3.raw

SEQ ID NO: 463159 - DNA, 534 bp, Homo sapiens; identical to SEQ ID NO: 445832
  misc_feature: HEFZJCU01C8811.17.28.C06.1.454.heavy.3.raw

SEQ ID NO: 463160 - DNA, 511 bp, Homo sapiens; identical to SEQ ID NO: 446675
  misc_feature: HEFZJCU01CO32S.4.23.C01.1.454.heavy.3.raw

SEQ ID NO: 463161 - DNA, 511 bp, Homo sapiens
  misc_feature: HEFZJCU01DVXFU.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagcgtggtttccgtgttaggctctttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaatgaacaatctgagagtcgacgatacggctgtctatcattgtgttttcgatgccttcggtccgcgggacttctggggccagggtaacccg

SEQ ID NO: 463162 - DNA, 518 bp, Homo sapiens; identical to SEQ ID NO: 444718
  misc_feature: HEFZJCU01CE8XU.9.34.D01.1.454.heavy.3.raw

SEQ ID NO: 463163 - DNA, 524 bp, Homo sapiens
  misc_feature: HEFZJCU01DC2X5.13.38.D05.1.454.heavy.3.raw
tcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtctgggggggcttggttaagcctggggggtccctcagactctcctgtgcaacctctggattcattttctctgacgcctggttgagctgggtccgccaggctcccgggaaggggctggagtgggttggccgtattaaaggtagaagacatggtcggacaacagactacagtgttcccgtgaaaggcagattcactatctcaagagatgactcaaagaaatgatatatctgcaaatgaacaacctgaaaagcgaggacacaggcgtgtattactgtaccacagatgggccagatgcaaatggccgcgacgagttcgactatc

SEQ ID NO: 463164 - DNA, 513 bp, Homo sapiens
  misc_feature: HEFZJCU01C347L.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccagcggagttccaagtactcctttgacgtctggggc

SEQ ID NO: 463165 - DNA, 517 bp, Homo sapiens
  misc_feature: HEFZJCU01EP9G6.48.29.C07.1.454.heavy.3.raw
agtatacatacacgaccggtgctcgatttagagtgctacgaagggaaaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagacctctggatacaccttcacgaactgtgctattcattgggtgcgacaggcccctggacaagggcttgagtggatggggtggatcaacaccaacactgggaacccaacgtatgcccagggcttcacaggacgatttgtcttctccttggacacctctgtcaatacggcacatctgcagatcaccagcctgaagactgaggacactgccgtgtattcttgtgtgagacgaagtagtagctcgccctcctttgactactggggccagggaaccctggtcaccgcctcc

SEQ ID NO: 463166 - DNA, 514 bp, Homo sapiens
  misc_feature: HEFZJCU01CI3HR.3.71.G05.1.454.heavy.3.raw
agacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggattttccttttggctattttaaaaggtgtccggtgtgaagtgcaactggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtgataacatcggctatgcggactctgtgaagggccgattcaccatctccagagacaacgccaagaactccctgtatctgcaaatgaacagtctgagacctgaggacgacggccttgtattactgtgtaaacggtcccggggaaatatgtacgtattttta

SEQ ID NO: 463167 - DNA, 531 bp, Homo sapiens
  misc_feature: HEFZJCU01AEL2V.49.34.D01.1.454.heavy.3.raw
agtcgagagacacgaccggtgctcgatttagatcgtctgtgttgggttttcctcgttgctcttttaagaggtgtccagtgtcaggtgcagctggtggagtctgggggaggcgtggtccagcctgggaggtccctgagactctcctgtgtagtctctggattcaccttcagggtctatgacatgcactgggtccgccaggctccaggcaaggggctggagtgggtggcagttatatcaaatgatgcaagtaacaaatactatgtagactccgtgaagggccgattcaccatctccagagacaattccaagaatacgctgtatctgcacatgaacagcctgagagccgaaagacacgggtgtttattactgtgcgaacttaattacggaggacaacggtaaccccgtccgcacggtacggacgtctgggccaagggaccacggtcaccgtctcctcagcctccaccaagggcccatcggtcttcccctcggcaccctcctccaagagcacctctcgggggcacagcggccctc

SEQ ID NO: 463168 - DNA, 395 bp, Homo sapiens
  misc_feature: HEFZJCU01BNM3Q.18.1.A01.1.454.heavy.3.raw
tacgagtatgcacgaccggtgctcgatttagacgtctcatcaaggaagggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactgggccagggcactccggtcaccgtctcctcagcctccaccaaggcccatcggtcttccccctggcaccctcctccaagagcacctctgggggcacagcggccctgggctgcctggtcaaggactacttcccatactcgta

SEQ ID NO: 463169 - DNA, 504 bp, Homo sapiens
  misc_feature: HEFZJCU01B4UZT.10.35.D02.1.454.heavy.3.raw
catagtagtgcacgaccggtgctcgatttagcacacgatagttgggtttgggggaggcttggttaagccgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctggcgccctgctccaggagcacctccgagagcacagcggccctgggctgcctggtcaaggactacttcccactacctatg

SEQ ID NO: 463170 - DNA, 513 bp, Homo sapiens
  misc_feature: HEFZJCU01DRKDX.4.57.F02.1.454.heavy.3.raw
agcactgtagcacgaccggtgctcgatttagctcgatatagttgggtttggggggaagaggaagactgacggtcctcccaggtgtccagtgtcaggtgcacctggtggagtcggggggaggcgtggtccagccgtggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgcctgctccaggagcacctctggggcacagcc

SEQ ID NO: 463171 - DNA, 392 bp, Homo sapiens; identical to SEQ ID NO: 444682
  misc_feature: HEFZJCU01CQB3H.16.70.G04.1.454.heavy.3.raw

SEQ ID NO: 463172 - DNA, 521 bp, Homo sapiens
  misc_feature: HEFZJCU01B5UA1.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatcctccagagacaattccaagaacacgctgtttcttcaaatgaacagcctgagagccgatgacacggccgtgtattactgtgcgagagatggggcccacgaacgttactacgctatggacgtctggggccgaagggaccg

SEQ ID NO: 463173 - DNA, 512 bp, Homo sapiens
  misc_feature: HEFZJCU01CPM20.3.34.D01.1.454.heavy.3.raw
  modified_base (368)..(368): a, c, t, g, unknown or other
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcncctggggccaagggaccacggtcatcgtctccgcagcctcaccaagggcccatcggtcttccccctggcaccctccctccaagagcacctctgggggcacagcggccctgggctgcctggtcaaggctacttccgagtgcgtct

SEQ ID NO: 463174 - DNA, 516 bp, Homo sapiens
  misc_feature: HEFZJCU01C6RTX.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccaggggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctcg

SEQ ID NO: 463175 - DNA, 523 bp, Homo sapiens
  misc_feature: HEFZJCU01A1KXC.13.33.C11.1.454.heavy.3.raw
tcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacggcaaatatggttcagggagttcgactactgggggccaggggaaccctggtcaccgtctcctcagcctccaccaaggg

SEQ ID NO: 463176 - DNA, 522 bp, Homo sapiens
  misc_feature: HEFZJCU01DAZJT.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggcctccgagggaaggggctggagtgcgtctcttttatttatagtagtggtagtacatactccgcagactccgtgagggccgattcaccatctccagagacaattccaagaacacgctgtttcttcaaatgaacagcctgagagccgatgacacggccgtgtattactgtgcgagagagtggggcccaacgaaccgtttactacgctagtggacgtcgtggggacccg

SEQ ID NO: 463177 - DNA, 506 bp, Homo sapiens
  misc_feature: HEFZJCU01EHBG4.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtcccttactttgactactggggccagggaactctggtcaccgtctccgcagcctccacc

SEQ ID NO: 463178 - DNA, 385 bp, Homo sapiens; identical to SEQ ID NO: 444438
  misc_feature: HEFZJCU01DDNH1.18.60.F05.1.454.heavy.3.raw

SEQ ID NO: 463179 - DNA, 522 bp, Homo sapiens
  misc_feature: HEFZJCU01DRZ8E.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactgggccaggacctggtcacgtctctcagcctcacacgg

SEQ ID NO: 463180 - DNA, 570 bp, Homo sapiens
  misc_feature: HEFZJCU01DZG05.52.49.E05.1.454.heavy.3.raw
cgcagtacgacacgaccggtgctcgatttagagcgactagcaacacacaaaggggacccaaaaaccacacccctccttgggagaatcccctagatcacagctcctcaccatggcctggacctggagcatccttttcttggtggcagcagcaacaggtgcccactcccaggttcacctggtgcagtcgggaggtgaggttaagaggcctggggcctcagtgaaggtcgcctgcaaggcttcaggttacaccctttccacgtctggtatcagttgggtgcgacaggcccccggacaagggcttgagtggatgggatggatcagcggtgacaacggcaacacaaattatggacagaagttccagggcagagtcaccatgaccgcggacacatccacgaacacagcctacatggagctgaggagcctaagatctgacgacacggccgtttattactgtgtgagagtagttttagggacctcgggcccgttggggggagtttagtcggtttacttttggaccttacgttcgggggaccctaaggggaaccccagggtccaacccggttcttcccc

SEQ ID NO: 463181 - DNA, 491 bp, Homo sapiens; identical to SEQ ID NO: 444592
  misc_feature: HEFZJCU01CPQM6.11.26.C04.1.454.heavy.3.raw

SEQ ID NO: 463182 - DNA, 520 bp, Homo sapiens; identical to SEQ ID NO: 447034
  misc_feature: HEFZJCU01AEL55.16.10.A10.1.454.heavy.3.raw

SEQ ID NO: 463183 - DNA, 502 bp, Homo sapiens
  misc_feature: HEFZJCU01DF3II.10.75.G09.1.454.heavy.3.raw
catagtagtgcacgaccggtgctcgatttagtatagacatcagggtctccctcactgcccagctgggatctcagggcttcattttctgtcctccaccatcatggggtcaaccgccatcctcgccctcctcctgactgttctccaaggtcagtcctgccgagggcttgaggtcacagaggagaacgggtggaaaggagccccggattcaaattttggttcccccccacaggagtctgtgccgaggtgcagctggtgcagtcaggagcagaggtaaagaggcccggggagtctctgaagatctcctgtaaggcctctggattcatgtttagccactcctggatcggctgggtgcgccagatgcccgggaaaggcctgggagtggagtggggatcatcgtggcctagtgactctgatatcagatacagtccgtccttccaaggccaggtcaccatctcagccgacaacgtccatcagccaccgcctactctgcagtggagtagcc

SEQ ID NO: 463184 - DNA, 512 bp, Homo sapiens; identical to SEQ ID NO: 449104
  misc_feature: HEFZJCU01C4ZUY.11.13.B02.1.454.heavy.3.raw

SEQ ID NO: 463185 - DNA, 488 bp, Homo sapiens; identical to SEQ ID NO: 447495
  misc_feature: HEFZJCU01DGYMK.22.86.H09.1.454.heavy.3.raw

SEQ ID NO: 463186 - DNA, 526 bp, Homo sapiens
  misc_feature: HEFZJCU01EVJYF.53.64.F09.1.454.heavy.3.raw
cgcgtatacacacgaccggtgctcgatttagcgcgtatacaaggggctgagagaggagcccagccctgggattttcaggtgttttcatgtggtgatcaggactgaacagagagaactcaccatggagtctgggctgacgtggctttttcttgtggctattttaaaaggtgtccagtgcgacgtgcagctggtggagtcggggggaggcttggtacagccgggggggtccctgagactctcctgtagagtctctggcttcacctttagagtctatgacatgagttgggtccgccaggctccggggaagggctggagtgggtctcaacgatcagtgatagcggaagtaccacaaactacgccgcctccgtgaagggccgatgcaccgtctccagagacaattcgaaggacactttatatctgcaactcaacagactgacaaccgctgacacggccgtctattactgtgtcaaagaagacggaccgcgtggacgaggagccagaaggaaaatcactactttgactacgt

SEQ ID NO: 463187 - DNA, 504 bp, Homo sapiens
  misc_feature: HEFZJCU01C6XM7.10.12.B01.1.454.heavy.3.raw
catagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatctgggggaggcgtggtccagccagggaggtccctgagactctcctgtgcagcctctggattgaggttcaataactatgctatgcactgggtccgccaggctccagggaagggctggaatggatgacagttatttcacacgatgcaaccaaacatactacgcggagttcgtgaggggccgctgcatcgtctccagagacaattcgaagaacactctgtacctgcaaatgaacagtctgagagccgaggacacggccgtctacttttgtgcgactagaagtgggagctaagtaggggattt

SEQ ID NO: 463188 - DNA, 518 bp, Homo sapiens
  misc_feature: HEFZJCU01EDA8P.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccggtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttatagttccctactttgactactggggccagggactctggtcaccgtctccgcagcctccaccaacgggcccatcc

SEQ ID NO: 463189 - DNA, 501 bp, Homo sapiens
  misc_feature: HEFZJCU01D7HU3.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtctttttgatgcctttgatatgtggggccaagggacaatggtcaccgtctt

SEQ ID NO: 463190 - DNA, 516 bp, Homo sapiens; identical to SEQ ID NO: 445437
  misc_feature: HEFZJCU01ASHCJ.26.71.G05.1.454.heavy.3.raw

SEQ ID NO: 463191 - DNA, 519 bp, Homo sapiens
  misc_feature: HEFZJCU01ESWOM.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagtcgatgacacggccgtgtattactgtgcgagagatggggcccacgaacgttactacgctatggacgtctggggccaagggaccg

SEQ ID NO: 463192 - DNA, 504 bp, Homo sapiens
  misc_feature: HEFZJCU01AH8QY.14.85.H08.1.454.heavy.3.raw
cgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggatccgccagcccccagggaaggggctggagtggattggggaaatcagtcaaagtggaggcaccaagtacaacccgtccctcgagagtcgagtcaccatatcaatagacacgttccagaatcagttctccctgaggctgacttctgtgacagccgcggacacggctgtgtattactgtgcgagatctttcggctggtacgctcttgactactgggggccagggaaccctggtcaccgtctcttcagcctccacc

SEQ ID NO: 463193 - DNA, 521 bp, Homo sapiens
  misc_feature: HEFZJCU01C2BOX.10.30.C08.1.454.heavy.3.raw
catagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatctgggggagccttggtacagcctggcgggtccctgagactctcctgtacagtctctggattcacctctgatgattatgccatgcactgggtccggcaagctccagggaagggcctggagtgggtctctggaatcacttacaatagtgatttccttaaatatgcggactctgtgagggggcgtttcaccatctccagagacaacgccaggaactccctctatctacaaatgaacagtctgagacctgaggacacggccttatatttctgtgcaaaagatcttggagctggccgtgaccactggggccagggaaccctc

SEQ ID NO: 463194 - DNA, 476 bp, Homo sapiens
  misc_feature: HEFZJCU01E1BL2.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctctgggggcacagcggccctgggctgcctggtcaaggctacttccgagtagtaca

SEQ ID NO: 463195 - DNA, 534 bp, Homo sapiens
  misc_feature: HEFZJCU01E0SN9.11.10.A10.1.454.heavy.3.raw
cgagagataccacgaccggtgctcgatttagcgtcgatctcaggggctgtcgtgatgattgcgtggtgggactctgtcccgctccaaggcacccgctctctgggacgggtgccccccggggtttttggactcctgggggtgacttagcagccgtctgcttgcagttggacttcccaggccgacagtggtctggcttctgaggggtcaggccagaatgtggggtacgtgggaggccagcagagggttccatgagaagggcaggacagggccacggacagtcagcttccatgtgacgcccggagacagaaggtctctgggtggctgggtttttgtggggtgaggatggacattctgccattgtgattactactactactactacatggacgtctggggcaaagggaccacggtcaccgtctcctcagcctccaccaagggcccatcggtcttccccctggcaccctcctccaagagcacctctgggggcacagcggccctgggctgcctggtcaaggactacttccgtatctctcg

SEQ ID NO: 463196 - DNA, 524 bp, Homo sapiens; identical to SEQ ID NO: 446401
  misc_feature: HEFZJCU01BS7IY.3.82.H05.1.454.heavy.3.raw

SEQ ID NO: 463197 - DNA, 394 bp, Homo sapiens
  misc_feature: HEFZJCU01DUORC.18.31.C09.1.454.heavy.3.raw
tacgagtatgcacgaccggtgctcgatttagacgtctcatcaaggaaggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactgggccagggcactccggtcaccgtctcctcagcctccaccaagggcccatcggtcttccccctggcaccctcctccaagagcacctctggggcacagcggccctgggctgcctggtcaaggactacttcccatactcgta

SEQ ID NO: 463198 - DNA, 520 bp, Homo sapiens
  misc_feature: HEFZJCU01BD24U.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagcgtgggttttccgttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgttcttcaaatgaacagcctgagagccgatgacacggccgtgtattactgtgcgagagatggggcccacgaacgttactacgctatggacgtctggggccaagggaccg

SEQ ID NO: 463199 - DNA, 502 bp, Homo sapiens
  misc_feature: HEFZJCU01D0ZB8.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttccccctggcgccctgctccaggagcacctccgagagcacagcggcccgtgggctgcctggtcaaggactactccacta

SEQ ID NO: 463200 - DNA, 531 bp, Homo sapiens
  misc_feature: HEFZJCU01EY775.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggacgtacggtgacttacgtgggggttcgaccccgtggggccaggggaaccctggtcaccgtctcctcagcctccaccg

SEQ ID NO: 463201 - DNA, 466 bp, Homo sapiens
  misc_feature: HEFZJCU01D1JF7.16.78.H01.1.454.heavy.3.raw
tgtactactccacgaccggtgctcgatttagtgtgagtagtttgggtttgggctcaactctcctgtgcagcctctggattcaccttgagaacttatagcatgaactgggtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcgggggactacctcgacccctgggccagggaatactggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 463202 - DNA, 532 bp, Homo sapiens
  misc_feature: HEFZJCU01DAJU2.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacaatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactacgtgggggttcgaccccgtggggccgacgggaaccgtggtcaccgtctcctcacgcctccaccg

SEQ ID NO: 463203 - DNA, 481 bp, Homo sapiens
  misc_feature: HEFZJCU01EOBN5.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctggcaccctcctccaagagcacctctgggggcacagcggccctgggctgcctggtcaaggactacttcgatctctcg

SEQ ID NO: 463204 - DNA, 470 bp, Homo sapiens; identical to SEQ ID NO: 444866
  misc_feature: HEFZJCU01CKJ2K.4.36.D03.1.454.heavy.3.raw

SEQ ID NO: 463205 - DNA, 513 bp, Homo sapiens
  misc_feature: HEFZJCU01ETO8H.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggagatggctggtggacagatcactggggccac

SEQ ID NO: 463206 - DNA, 512 bp, Homo sapiens; identical to SEQ ID NO: 445688
  misc_feature: HEFZJCU01EXJMW.3.34.D01.1.454.heavy.3.raw

SEQ ID NO: 463207 - DNA, 503 bp, Homo sapiens; identical to SEQ ID NO: 454696
  misc_feature: HEFZJCU01BB4W2.51.43.D10.1.454.heavy.3.raw

SEQ ID NO: 463208 - DNA, 481 bp, Homo sapiens; identical to SEQ ID NO: 447643
  misc_feature: HEFZJCU01CTXKY.11.23.C01.1.454.heavy.3.raw

SEQ ID NO: 463209 - DNA, 435 bp, Homo sapiens
  misc_feature: HEFZJCU01CR0E6.40.27.C05.1.454.heavy.3.raw
tctagcgactcacgaccggtgctcgatttagacgcgatcgaagggtttggggctgggtccgccggcccccagggaaggggctggagtggattgcgagcatatattatgatgagagcgccctctacaaccccccccctctacaacccctccctcaagagtcgggtcaccatatctatagacacgtccaacagtcaattctccctggacttgacctctgtgaccgccgcagacacggctgtatattcctgtgcgaggcccccgagcgcagtggcttttgatgcctttgatatggtggggccaagggacaatggtcaccgtctcttcagcctccaccaagggcccatcggtcttccccctggcaccctcctccaagagcacctcgtgggggcacagcggccctgggctgcctggtcaggactacttccagtcgctaga

SEQ ID NO: 463210 - DNA, 503 bp, Homo sapiens; identical to SEQ ID NO: 445995
  misc_feature: HEFZJCU01C8CD0.17.25.C03.1.454.heavy.3.raw

SEQ ID NO: 463211 - DNA, 335 bp, Homo sapiens
  misc_feature: HEFZJCU01ALCN1.3.31.C09.1.454.heavy.3.raw
agacgcactccacgaccggtgctcgatttagacgtctcatcaaggaaggaagggccgattcaccatctccagagacaaagccaagaactcactgtatctggaaatgaacagcctgagagccgaggacacggctgtgtattactgtgcgagaggcggctttggggttcaggaccgtcctacgctatggacgtctggggccaagggaccacggtcaccgtctcctcagcctccaccaagggcccatcggtcttccccctggcgccctgctccaggagcacctccgagagcacagcggccctgggctgcctggtcaaggactacttccgagtgcgtct

SEQ ID NO: 463212 - DNA, 518 bp, Homo sapiens; identical to SEQ ID NO: 448653
  misc_feature: HEFZJCU01AVWBS.13.76.G10.1.454.heavy.3.raw

SEQ ID NO: 463213 - DNA, 493 bp, Homo sapiens
  misc_feature: HEFZJCU01EDM65.51.34.D01.1.454.heavy.3.raw
cgatcgtatacacgaccggtgctcgatttagatcgtctgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggctctttttactgtgcgccaggaagcagtggctgg

SEQ ID NO: 463214 - DNA, 490 bp, Homo sapiens
  misc_feature: HEFZJCU01CHVOO.48.27.C05.1.454.heavy.3.raw
agtatacatacacgaccggtgctcgatttagacgcgatcgaagggtttgggggcatcacagaacaaccacactcctcctctaaagaagcccctgggagcacggcgcatcaccatggactggacctggaggttcctctttgtggtggcagcagctacatgtgtccagtcccaggtacagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttatggtggataaagccacgagcacagtctacatgcagctgagcagcctgagacacaacgacacggccgtctattattgttccagagataatcgcgtgaataaagatatggaa

SEQ ID NO: 463215 - DNA, 523 bp, Homo sapiens
  misc_feature: HEFZJCU01DMG6Z.11.25.C03.1.454.heavy.3.raw
  modified_base (499)..(499): a, c, t, g, unknown or other
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggcctgtattactgtgcgagagatggggcccacgaacgttcacgctanggacgtctggggccaagggaccac

SEQ ID NO: 463216 - DNA, 526 bp, Homo sapiens
  misc_feature: HEFZJCU01C3OOR.48.42.D09.1.454.heavy.3.raw
agtatacatacacgaccggtgctcgatttagacacatacgcagggaaagggggctttctgagagtcagggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggttggatccgccagcccccagggaaggggctggagtggattgggagtatgcactatagtgggagcacccactacaccccgtccctcaagagtcgagtcaccatatccgtagacacgtccaagaatcagttctccctgaagctgacctctgtgaccgccgcagacacggctgtttattactgtgtgagacggggtgccccaagaaaaacgtgttttaatcccttggggccaggggaaccctggtcaccgtctcctcagcctccaccaagggccc

SEQ ID NO: 463217 - DNA, 519 bp, Homo sapiens
  misc_feature: HEFZJCU01DIM29.9.43.D10.1.454.heavy.3.raw
tgatacgtctcacgaccggtgctcgatttagactagcagtaaggggctgggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatgggtctcagttattcataccgacggtaccatatatgacgcagactccgtgaagggccgattcaccatctccagagaccattccaagaacaccctatatcttcaaatgaacaacctgagagtcgaagacacggccgtatattactgtgcgagacatgacttcggtgacccctggggccagggaaccctggtcaccgtctcctc

SEQ ID NO: 463218 - DNA, 504 bp, Homo sapiens
  misc_feature: HEFZJCU01BDV2C.51.78.H01.1.454.heavy.3.raw
cgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggattttccttttggctattttaaaaggtgtccagtgtgaagtgctactggtggagtctgggggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttggtattactgcgcaaaagccaaaggcaacagctggta

SEQ ID NO: 463219 - DNA, 501 bp, Homo sapiens
  misc_feature: HEFZJCU01CAMQF.48.34.D01.1.454.heavy.3.raw
agtatacatacacgaccggtgctcgatttagatcgtctgtgttgggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttccccctggcgccctgctccaggagcacctccgagagcacagcggccctgggctgcctggtcaggactacttcctatgtatact

SEQ ID NO: 463220 - DNA, 495 bp, Homo sapiens; identical to SEQ ID NO: 447874
  misc_feature: HEFZJCU01C4VNW.4.21.B10.1.454.heavy.3.raw

SEQ ID NO: 463221 - DNA, 517 bp, Homo sapiens
  misc_feature: HEFZJCU01D5GKP.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctggggccggggaaccctggtcacgtctcccacctccaccaaggcccatcggtctcccctggcaccctcctccaagagcacctctgggggcacagcggccctggctgcctgtcaaggactacttccatactcgta

SEQ ID NO: 463222 - DNA, 509 bp, Homo sapiens; identical to SEQ ID NO: 447939
  misc_feature: HEFZJCU01BHXYT.17.25.C03.1.454.heavy.3.raw

SEQ ID NO: 463223 - DNA, 519 bp, Homo sapiens
  misc_feature: HEFZJCU01A3PBA.52.26.C04.1.454.heavy.3.raw
cgcagtacgacacgaccggtgctcgatttagtctagcgactttgggtttggggtctgggagaggagcccagcactgggattccgaggtgtttccattcagtgatctgcactgaacacagaggactcgccatggagtttgggctgagctgggttttccttgttgctattttaaaaggtgtccagtgtggagtgcaggtggtggagtctgggggaggcttggtccagcctggtggttccctgagactctcctgtgcagcctctggattctccgtcagtagcaactacatgagctgggtccgccaggctccagggaagggctggagtgggtctcaagtctttatgtcggtggtaccacatattatgctgactccgtgaagggccgattcaccatctccagagacgagtccaggaacagcctgtttcttcaaatggacagtctgagcctgacgacacggctgtctattactgtgcgagagaacccgagggggcgggagcacgcccgtaacttctgggggccac

SEQ ID NO: 463224 - DNA, 533 bp, Homo sapiens
  misc_feature: HEFZJCU01B2TIV.17.33.C11.1.454.heavy.3.raw
cgtagactagcacgaccggtgctcgatttagagtgagctcgttgggtttgggctcaactctcttgtcccagatcaccttgaaggagtctggtcctacgctggtgaaacccacacagaccctcacgctgacctgcaccttctctggcttctcactcagaacgagtggaatgggagtggggctggataccggtcacgcccctaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctccaccaagggcccatcggtcttcccctggcaccctcctccaacgagcacctctggggggcacagcggccctggggcctgcctggtacg

SEQ ID NO: 463225 - DNA, 518 bp, Homo sapiens
  misc_feature: HEFZJCU01DBGIE.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccaggcgggagttccaagtacttcc

SEQ ID NO: 463226 - DNA, 526 bp, Homo sapiens
  misc_feature: HEFZJCU01AU982.48.27.C05.1.454.heavy.3.raw
agtatacatacacgaccggtgctcgatttagacgcgatcgaagggtttggggggaagaggaagactgacggtccccccaggagttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagaagggttttactatggttcggggagtctccgacccagcaactggttcgaccctggggccagggaaccctggtcaccgtctcctcagcctccaccaagggcccatcggtcttcccctggcaccctcctccaagagcacctctgggggcacacg

SEQ ID NO: 463227 - DNA, 526 bp, Homo sapiens; identical to SEQ ID NO: 448857
  misc_feature: HEFZJCU01BLY2L.7.70.G04.1.454.heavy.3.raw

SEQ ID NO: 463228 - DNA, 486 bp, Homo sapiens
  misc_feature: HEFZJCU01D0F7K.19.13.B02.1.454.heavy.3.raw
tactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcaggttatatcatatgatggaagtaataaatactatgcagactccgtgaagggccgattcaccatctccagagacaattccaagaacacgctgtatctgacaaatgaacagcctgagagctgaggacacggctgtgtattactgtgcgaggcggt

SEQ ID NO: 463229 - DNA, 486 bp, Homo sapiens; identical to SEQ ID NO: 444861
  misc_feature: HEFZJCU01EMUKJ.47.55.E11.1.454.heavy.3.raw

SEQ ID NO: 463230 - DNA, 447 bp, Homo sapiens
  misc_feature: HEFZJCU01DBEX4.49.82.H05.1.454.heavy.3.raw
agtcgagagacacgaccggtgctcgatttagtcgagctctctcgcgggcacgaccggtgctcgatttagtcgagctctctcgcggtcacgaccggtgctcgatttagtacagatcgttagggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatccctggtcatcgtctcctcagcctcaccaaggcccatcggtcttcccctggcgccctgctccaggagcacctcccgagagcacagcggccctgggctgcctggtcaaggactacttcctctctcgact

SEQ ID NO: 463231 - DNA, 518 bp, Homo sapiens; identical to SEQ ID NO: 444718
  misc_feature: HEFZJCU01B96F7.9.34.D01.1.454.heavy.3.raw

SEQ ID NO: 463232 - DNA, 403 bp, Homo sapiens
  misc_feature: HEFZJCU01DQ4QD.19.81.H04.1.454.heavy.3.raw
tactctcgtgcacgaccggtgctcgatttagtagtgtagattcgcggatgtctctgtggtcaaggtgagtctgtcctggaatttctgtgacaacattgtcacagaaattccaggacagactcaccttgaccacagagacatccgcgaatacagcctacatggacctgggcagcctgacgtctgaagacacggctacatattattgtgtgagagattggaatcgggagactaactggagtcgtgacgttcttttcgacccctggggccaggggacctcggtcattgtctcctcagcctccaccaagggcccatcggtcttccccctggcgccctgctccaggagcacctccgagagcacagcggccctgggctgcctggtcaaggactacttcccacgagagta

SEQ ID NO: 463233 - DNA, 502 bp, Homo sapiens
  misc_feature: HEFZJCU01BBAE3.12.55.E11.1.454.heavy.3.raw
atacgacgtacacgaccggtgctcgatttagcactcgcacgttgggttttcctcgttgctcttttaagaggtgtccagtgtcagatgcagctggtggagtctggggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataacagtctgagacttgaggacacggctgtctattactgtgcgagagactacggtgaccttttctggcatttcgatctctggggccgtggcacctggtcactgtctcctcggcttccaccaagggcccatcggtcttcccctggccgccctgctccaggagcacctctggggg

SEQ ID NO: 463234 - DNA, 469 bp, Homo sapiens
  misc_feature: HEFZJCU01ACKNW.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggcccatcggtcttcccctggcgccctgctccaggagcacctccgagagcacagcggccctgggctgcctggtcaaggactactccctacagtgct

SEQ ID NO: 463235 - DNA, 537 bp, Homo sapiens
  misc_feature: HEFZJCU01CP0SX.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcattttttagcgaatatgccatgagctgggtccgccaggctccagggaaggggctggagtgggtctcagcaatcagtggttctagtggaagtacattcgacgccgtctccgtgaagggccggttctccatctcagagacaattccaagaacactctatttcttcaaatggacagcctgaaagacgaagacacgggcgtgtatttttgtgtgaaagatacgaagtctatgatacccaatttgggaggggccgtttcatgtctggggccaagggacgctggtcaccgtctcttcagcctccaccaagggcccatcggtcttccctggcaccctcctccaagagcacctctgggggcacagcc

SEQ ID NO: 463236 - DNA, 514 bp, Homo sapiens; identical to SEQ ID NO: 462537
  misc_feature: HEFZJCU01AP3NO.7.71.G05.1.454.heavy.3.raw

SEQ ID NO: 463237 - DNA, 484 bp, Homo sapiens
  misc_feature: HEFZJCU01DYYQM.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgcttcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatacgaagaaccagttctccctgcagctgacctctgtgactccgagacgacggtgtatattactgtggaagacggccccataacg

SEQ ID NO: 463238 - DNA, 505 bp, Homo sapiens; identical to SEQ ID NO: 445664
  misc_feature: HEFZJCU01ELTFB.12.33.C11.1.454.heavy.3.raw

SEQ ID NO: 463239 - DNA, 518 bp, Homo sapiens
  misc_feature: HEFZJCU01A93WQ.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgacgaaccgacgacacggccgtctattatgtgtcatagacctaggatacaacgacggtggtacctggtattc

SEQ ID NO: 463240 - DNA, 520 bp, Homo sapiens
  misc_feature: HEFZJCU01DUKK4.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccacagactccgtgaggggccattcaccatctccagagacaattccagaacacgctgtttcttcaaatgaacagcctgagagccgatgacacggccgtgtattactgtgcgagagagtggggcccacgaacgttactacgctatggacgtcgtggggccaagggacccg

SEQ ID NO: 463241 - DNA, 495 bp, Homo sapiens; identical to SEQ ID NO: 454812
  misc_feature: HEFZJCU01DS45G.16.37.D04.1.454.heavy.3.raw

SEQ ID NO: 463242 - DNA, 472 bp, Homo sapiens; identical to SEQ ID NO: 447846
  misc_feature: HEFZJCU01DHB8R.22.56.F01.1.454.heavy.3.raw

SEQ ID NO: 463243 - DNA, 527 bp, Homo sapiens
  misc_feature: HEFZJCU01A230S.12.40.D07.1.454.heavy.3.raw
atacgacgtacacgaccggtgctcgatttagtgatagagcgtaacaacagaggactcaccatggagtttgggctgagcgtgggttttcctcgttgctcttttaagaggtgtccagtgtcaggggcacctggtggagtctgggggagccgtggtccagcctgggcggtcccgtgacgactacggcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttccccctggcg

SEQ ID NO: 463244 - DNA, 523 bp, Homo sapiens; identical to SEQ ID NO: 446270
  misc_feature: HEFZJCU01EKQWX.12.40.D07.1.454.heavy.3.raw

SEQ ID NO: 463245 - DNA, 536 bp, Homo sapiens
  misc_feature: HEFZJCU01A64OS.40.20.B09.1.454.heavy.3.raw
tctagcgactcacgaccggtgctcgatttagtgtagtgtgaagggggagagaggagccttagccctggattccaaggcctatccacttggtgatcagcactgagcaccgaggagtcaccatggaactgggactccgctgggttttccttgttgcgattttagaaggtgtcaagtgtgaggtgcgactggtcgagtctgggggaggcctggtcaagccgggggggtccctgagactctcctgtgcagcctctggactcaccttcaggagtttcagtatgaattgggtccgccaggctccagggaaggggctggagtgggtctcatccatcagcagtggtagcacttacatacactatgcagactcagtgaagggccgattcaccatctccagagacaacgccgggaactccctgtatctgcaaatgaagagcctgcgagccgaggacacggggtgtttattattgtaactaaaggacaaagaggggactttggggagtactactacggtatggacgtcgtggggccaaggggacccg

SEQ ID NO: 463246 - DNA, 514 bp, Homo sapiens
  misc_feature: HEFZJCU01CEDS6.48.60.F05.1.454.heavy.3.raw
agtatacatacacgaccggtgctcgatttagtacgtcatcagggaaagggggagagaggagccttagccctggattccaaggcctatccacttggtgatcagcactgagcaccgaggattcaccatggaactggggctccgctgggttatccttgttgctattttagaaggtgtccagtgtgaggtgcagctggtggagtcagggggaggcctggtcaagcctggggggtccctgagactctcctgtgcagcctctggattcaccttcagtacctataccatgaactgggtccgccaggctccagggaaggggctggagtgggtctcatccattagtagtagcagtaattatatagacgacgcagactcagtgaagggccgattcaccatctccagagacaacgccaagcactcactgtatctccaaatgaaacagcctgagagccgacgacacggctgtgtattactgtgcgagacttggggagaggaggtgggaccctactggttccctacg

SEQ ID NO: 463247 - DNA, 537 bp, Homo sapiens
  misc_feature: HEFZJCU01DYG52.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgtatttttggatgtctgggccgaaggtacagcggtcaccgtcgcctcagcctccaccaacgggcccagtccggttccttcccccgtcggccaccctccctccaacgacgcaccgtcgtggggggacacgac

SEQ ID NO: 463248 - DNA, 453 bp, Homo sapiens
  misc_feature: HEFZJCU01A9IIA.52.78.H01.1.454.heavy.3.raw
cgcagtacgacacgaccggtgctcgatttagtgtgagtagtttgggtttggggggaagaggaagactgacggtccccccaggagttcaggtgctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggccgtggcaccctggtcactgtcttctcagcctccaccaagggcccatcggtcttccccctggcaccctcctccaagagcacctctgggggcacagcggcctgggctgcctggtcaaggactacttcctatacgatcg

SEQ ID NO: 463249 - DNA, 517 bp, Homo sapiens
  misc_feature: HEFZJCU01C1K37.14.57.F02.1.454.heavy.3.raw
cgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaagggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtattttgtgtgaaagatacgaagtctatgatacccaatttggaggggctttcat

SEQ ID NO: 463250 - DNA, 536 bp, Homo sapiens; identical to SEQ ID NO: 458006
  misc_feature: HEFZJCU01DZI2F.17.28.C06.1.454.heavy.3.raw

SEQ ID NO: 463251 - DNA, 515 bp, Homo sapiens
  misc_feature: HEFZJCU01D7DIL.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaagggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgacgaaagccaccggcgagttagtccacccatacttactttgacttaacgtggggg

SEQ ID NO: 463252 - DNA, 485 bp, Homo sapiens
  misc_feature: HEFZJCU01DGCNS.53.50.E06.1.454.heavy.3.raw
cgcgtatacacacgaccggtgctcgatttagatctactgacaacacacaaggggtctgggagaggagcccagcactagaagtcggcggtgtttccattcggtgatcagcactgaacacagaggactcaccatggagtttgggctgagctgggtcttcctcgttgctcttttaagaggtgtccagtgccaggtgcagttggtggagtctgggggaggcgtggtccagcctgggcggtccctgagactctcctgtgcagcctctggattcaccttcagagtctatggcatgaactgggtccgccaggctccaggcaaggggctggagtgggtggcacttatactagatgatggaagtaataaatattatgcagactccgtgaagggccgattcaccatctccagagacaattccaagaacactctgtatctgcaaatgaacagcctgagacctgaggacacggctgtctactactgtgcgaaacggt

SEQ ID NO: 463253 - DNA, 501 bp, Homo sapiens; identical to SEQ ID NO: 445027
  misc_feature: HEFZJCU01DPIS1.26.23.C01.1.454.heavy.3.raw

SEQ ID NO: 463254 - DNA, 502 bp, Homo sapiens; identical to SEQ ID NO: 450016
  misc_feature: HEFZJCU01BKNV8.17.10.A10.1.454.heavy.3.raw

SEQ ID NO: 463255 - DNA, 496 bp, Homo sapiens
  misc_feature: HEFZJCU01CMBJB.40.81.H04.1.454.heavy.3.raw
  modified_base (490)..(490): a, c, t, g, unknown or other
tctagcgactcacgaccggtgctcgatttagtagtgtagattcgcgggggtgtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgngggtcg

SEQ ID NO: 463256 - DNA, 520 bp, Homo sapiens
  misc_feature: HEFZJCU01AQDW7.49.53.E09.1.454.heavy.3.raw
agtcgagagacacgaccggtgctcgatttagagagagtgtgttgggtttggggacccaacaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcaacggtcgtcatgggatttgactactggggccaggggaaccccggtcaccgtctcctctgcct

SEQ ID NO: 463257 - DNA, 396 bp, Homo sapiens; identical to SEQ ID NO: 444469
  misc_feature: HEFZJCU01EEO7E.47.46.E02.1.454.heavy.3.raw

SEQ ID NO: 463258 - DNA, 518 bp, Homo sapiens; identical to SEQ ID NO: 445423
  misc_feature: HEFZJCU01BLY14.7.78.H01.1.454.heavy.3.raw

SEQ ID NO: 463259 - DNA, 512 bp, Homo sapiens
  misc_feature: HEFZJCU01DX1BI.48.75.G09.1.454.heavy.3.raw
agtatacatacacgaccggtgctcgatttagtatagacatcagggggactcctgtgccccaccatggacacactttgctccacgctcctgctgctgaccatcccttcatgggtcttgtcccagatcaccttgaaggagtctggtcctacgctggtgaaacccacacagaccctcacactgacctgcaccttctcgggcttctcactcactcgtagtggggaggctgtggcctggattcgtcagcccccagggaaggccctggagtggcttgctctcatttactgggatactgatgaccgctacactccagctctgaaaaacaggctcaccatcgccatggacacctccaaaaacaggtggtccttaaaatgaccaacatggacccaatggacagcgcgacatattactgtgcacacattgattgtggtcccaccaggtgtcccgggccctttcgatatctggggccgggggacgattcgtcaccgtctctgcagctccaccaagggcccacg

SEQ ID NO: 463260 - DNA, 527 bp, Homo sapiens; identical to SEQ ID NO: 446775
  misc_feature: HEFZJCU01EGTFP.9.78.H01.1.454.heavy.3.raw

SEQ ID NO: 463261 - DNA, 498 bp, Homo sapiens
  misc_feature: HEFZJCU01ELF7F.40.59.F04.1.454.heavy.3.raw
tctagcgactcacgaccggtgctcgatttagtacacacacttagggattggggagctctgggagtggagccccagccttgggattcccaagtatttgtattcagtgatcaggactgaacacacaggactcaccatggagttggggctgagctgggttttccttgttgccatattagaaggtgtccactgtgaggtgcagctggcggagtctgggggagacttggtacagcctggggagtccctgagactctcctgtgcagcctctggattcaccttcagtttgtttgacatgcactgggtccgccaggctccaggaaaaggtctggagtgggtctcagtcatgggtacagctggtcacacatactatgcagactccgtaaagggccgattcaccatctccagagaagacgccaagaattccttgtatcttcagatgaacagtctgagaaccgatgacacggctgtgtattattgtgcaaaggggggagcagctcgtcc

SEQ ID NO: 463262 - DNA, 512 bp, Homo sapiens
  misc_feature: HEFZJCU01CSZRO.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcgactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagtcttttgactacgtggggccagggaaccctggtcatcgtctcctcagcctccaccaagggcccatcggtcttcccctggcaccctcctccaagagcacctcgtgggggcacgagccggccctgggctcgcctggtcaaggactacttccgagtagtaca

SEQ ID NO: 463263 - DNA, 532 bp, Homo sapiens
  misc_feature: HEFZJCU01B8EK2.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttgggccagggaaccctggtcaccgtctcctcagcctccaccaaggcccatcggtcttcccctggcaccctcctccaagagcacctccgtgggggcacagcggccctgggctgcctc

SEQ ID NO: 463264 - DNA, 517 bp, Homo sapiens
  misc_feature: HEFZJCU01ERWJV.40.31.C09.1.454.heavy.3.raw
  modified_base (503)..(503): a, c, t, g, unknown or other
tctagcgactcacgaccggtgctcgatttagacgtctcatcaaggaaggaaggggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctggcactgtctctggtggctccatcagcagcagtacttacttctggggctggatccgccagcccccagggaagggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgtatgtcctttgatatgtgggggtccgaagggacgaatggtcaccgtctcgttcngtcctccacctaac

SEQ ID NO: 463265 - DNA, 517 bp, Homo sapiens
  misc_feature: HEFZJCU01ATSRO.48.78.H01.1.454.heavy.3.raw
agtatacatacacgaccggtgctcgatttagtgtgagtagtttgggtttgggggctttctgagagtcatggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactgggcctggatccgccagccccccgggaagggactggaatggattgggagtatctattatacagggagcacctactacaacccgtccctcaagagtcgagtcaccatctccgcagacacgtccaagaaccagttctccctgaggctgagctctgtgaccgccgcagacacggctgtctattactgtgcgagaaggtggtcgtggcagtgctggtacgtggctctcagtggttcgacccgtggggccaggggataccgtggtcaccgt

SEQ ID NO: 463266 - DNA, 489 bp, Homo sapiens
  misc_feature: HEFZJCU01E08WB.49.17.B06.1.454.heavy.3.raw
agtcgagagacacgaccggtgctcgatttagtcgatagtgaaggggctgggagacgagcccagcactggaagtcgccggtgtttccattcggtgatcatcactgaacacagaggactcaccatggagtttgggctgagctgggttttcctcgttgctcttttcagaggtgtccagtgttatgtgcagctggtggagtctgggggaggcgtggtccagcctgggaggtccctgagactcgcctgcaaaccgtccggattcaccttcagtaattatgcaatgcactgggtccgccagactccaggcaaggggctgcactgggtggcggccatatcatttgatggaagcaagaaatactatgcagactccgtgaggggccgattcaccatctccagagacagttccgatgacacagtgtatctgcaaatgaacagcctgagacctgaggacacggctctcttttactgtgcgccaggaagcagtgctggccg

SEQ ID NO: 463267 - DNA, 508 bp, Homo sapiens
  misc_feature: HEFZJCU01DOO05.8.38.D05.1.454.heavy.3.raw
ctcgcgtgtccacgaccggtgctcgatttagtatctgatagttgagctctgggagaggagcccatcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggcgtggtccagcctgggaggtccccgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaatggacagcctaagagttgaggacacggctgtttattactgtacgaaagaggggggatacagtgcagctccaagtactacttt

SEQ ID NO: 463268 - DNA, 502 bp, Homo sapiens
  misc_feature: HEFZJCU01C94LJ.9.81.H04.1.454.heavy.3.raw
tgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttccttttgggtattttaaaaggtgtccagtgtgaagtgcagctggtggagtctgggggaggcttggtgcagcctggcacctccctgagactcccctgtgccgcctctggattcatgtttgatgattatgccatgcactgggtccggcaagttccagggaagggcctggagtgggtctcaggtattacttggagtagcactaccacaggctatgcggactctgtgaggggccgattcaccatctccagagacaacgccaagaactccctatatctgcaaatgaatggtctgagagttgaggacacggccttgtattactgtgcaaagataggaaaccccaggtggacgc

SEQ ID NO: 463269 - DNA, 483 bp, Homo sapiens
  misc_feature: HEFZJCU01ELPMI.51.1.A01.1.454.heavy.3.raw
cgatcgtatacacgaccggtgctcgatttagacgtctcatcaggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcatatgatggaagtaatatatactatgtagactccgtgaagggccgattcatcatctccagagacaattccgagaacacgctgtatctgcaaatgaacagcctgagagttgaggacacggctgtgtattatgtgcgaacttaatcac

SEQ ID NO: 463270 - DNA, 499 bp, Homo sapiens
  misc_feature: HEFZJCU01EYPZF.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggccggttctccatctccagagacaattccaagaacacgctgtatctgcaattgaacagcctgagagccgagggacacggccgtatattactggttgcgaaagattttgggggaatggaaccactc

SEQ ID NO: 463271 - DNA, 512 bp, Homo sapiens
  misc_feature: HEFZJCU01CTPSQ.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccaac

SEQ ID NO: 463272 - DNA, 547 bp, Homo sapiens
  misc_feature: HEFZJCU01BJFDO.49.22.B11.1.454.heavy.3.raw
agtcgagagacacgaccggtgctcgatttagacgacagctcaggggagctctgggagacgagcccagcactggaagtcgccggtgtttccattcggtgatcatcactgaacacagaggactcaccatggagtttgggctgagctgggttttcctcgctgctcttttaagagacgtccactgttttgtgggcctggtggagtctggggggggcgtggtccagcccgggaggtccctcagactctcctgtacagacccgacatcttacgtcaggattaataatgtacactggatccgccaggccccaggcaaggggctggagtgggtggcattggtgactcatgtggaagacagaaaattgtacgcagactccgtgaggggccgattcatcatctccaaagactactccaagaatacggtgtatcttcaaatgaatggcctcgtttttgcggacacggctgtttattatttgtgcgacgaggggggcccccctttccgtacggagcgatctatactactttcgtaccactggggccgacggggaaaccc

SEQ ID NO: 463273 - DNA, 529 bp, Homo sapiens
  misc_feature: HEFZJCU01B2GSU.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatgcccaggccttcacagggcggtttgtcttctccatggatacctctgtcgggacggcttatctgcagataaccaaccttcaacctgacgacactgccgtttatttttgtacgtagagcgtcgtctgtcagtggaattgactactggggccagggaacctggtcaccgtctcctcagcctcaccaagg

SEQ ID NO: 463274 - DNA, 521 bp, Homo sapiens
  misc_feature: HEFZJCU01EGC1N.47.64.F09.1.454.heavy.3.raw
agctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcaccagttttaattattggtggggctggatccgccagcccccagggaaggggctggaatggattgggagtatattttataatggggacactctttacaacccatccctcaagagtcgagtttccatatccgcagacacgtccgagaatcacttctccctgaaactgagctctgtgaccgccgcagacacggctgtttattactgttcgagacatgccgaccgagagcattatcggcagtacggttttgatatttggggccaagggacaagggtcaccgtctccgcacgcctccaccg

SEQ ID NO: 463275 - DNA, 521 bp, Homo sapiens
  misc_feature: HEFZJCU01B6FZK.48.65.F10.1.454.heavy.3.raw
agtatacatacacgaccggtgctcgatttagctacgctctaagggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctttctatggtgggtccttcagtggttactactggagctggatccgccagcccccagggaaggggctggagtggattggggaaatcaatcatagtggaagcaccaactacaacccgtccctcaggagtcgagtcaccatatcagtagacacgtccaagaaccagttctccctgaagctgagctctgtgaccgccgcggacacggctgtgtattactgtgcgagagcggatattgtagtagtaccagctgctatttttgtccggttggttcgaccccgtggggccagggaaccctggtcaccgtctcctcagcct

SEQ ID NO: 463276 - DNA, 507 bp, Homo sapiens
  misc_feature: HEFZJCU01C61RU.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccaccttattattgtgcgcgacatgactacgctcaattctggggccaggggacg

SEQ ID NO: 463277 - DNA, 525 bp, Homo sapiens
  misc_feature: HEFZJCU01ARLDP.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgctctggggccaggggaccctggtcatcgtctccccagcctccaccaaggcccatcggtcttccccctggccgccc

SEQ ID NO: 463278 - DNA, 510 bp, Homo sapiens; identical to SEQ ID NO: 453944
  misc_feature: HEFZJCU01B68BE.48.34.D01.1.454.heavy.3.raw

SEQ ID NO: 463279 - DNA, 527 bp, Homo sapiens
  misc_feature: HEFZJCU01D26CZ.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatcttcaaatagacagcctgagaccagacgacacggctgtctattattgcgcgagagagacacacgaacctactggccaatactatgggggcttgttctggggccagggggaccctggtcatcgtctccccagcctccaccaagggcccatcggtcttcccctggcgccctg

SEQ ID NO: 463280 - DNA, 508 bp, Homo sapiens
  misc_feature: HEFZJCU01AF3QL.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagactatgtggactctgtgaagggccgattcaccatctccagagacaacgccaagaactcactgtatctgcaaatgaacagcctaagacccgaggacacggctgtgtattactgtgcgagagaccgctactggggcccggagcccctggt

SEQ ID NO: 463281 - DNA, 540 bp, Homo sapiens
  misc_feature: HEFZJCU01CS9NO.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgaggaaaaagtaatggctgtgtttattgggggccaggggagcccctggtctacccg

SEQ ID NO: 463282 - DNA, 536 bp, Homo sapiens
  misc_feature: HEFZJCU01A3PY2.52.53.E09.1.454.heavy.3.raw
cgcagtacgacacgaccggtgctcgatttagagagagtgtgttgggtttggggggacctcctgtgcaagaacatgaagcacctgtggttcttcctcctgctggtggcggctcccagatgggtcctgtcccagctgcagctgcaagagtcgggcccacgactggtgaagcctgcggagcccctgtccctcacctgcactgtctctggtgactccatcaccaataatgattactactgggcctggatccgccagcccccagggaaggggctggagtggattggcagtatattttatactggaaatacctaccaaaacccgtccctcaacagccgactcaccatttcagtggacacgtccaagaaccagttctccctgaaactgagctctgtgaccgcccgcagacacggccatttattactgtgcgggagagaggcacaagactggagttcccgggagctggttcggctccgtggggccgaggggaccccggtcaccgtctcctcagcctccaccaagggcccatcggtcttcccctc

SEQ ID NO: 463283 - DNA, 400 bp, Homo sapiens
  misc_feature: HEFZJCU01C3DJG.16.80.H03.1.454.heavy.3.raw
tgtactactccacgaccggtgctcgatttagctgtgcgtcgaagggaaagggactggaatatgtttcagctattagttataatgggggtaacacatactacgcagactcagtgaagggcagattcaccatctccagagacaattcccagaacacgctggatcttcaaatgagcagtctgagagctgaggacacggctgtgtattactgtgtgaaagatttccgtggctactacgactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 463284 - DNA, 490 bp, Homo sapiens
  misc_feature: HEFZJCU01DSIVB.40.81.H04.1.454.heavy.3.raw
tctagcgactcacgaccggtgctcgatttagtagtgtagattcgcggggtgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctg

SEQ ID NO: 463285 - DNA, 520 bp, Homo sapiens
  misc_feature: HEFZJCU01EQYBM.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattacgtggggccgggaaccctggtcgccgtctcctcagcctccaccaacggcccatccggtcttccccctggccaccctcctccaagagcacctctgggggcacagcggccctgggctgcctgtcaaggactacttccagacgtatca

SEQ ID NO: 463286 - DNA, 501 bp, Homo sapiens
  misc_feature: HEFZJCU01CR8NB.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaaggggacactggtcaccgtctcttcagcctccaccaagggcccatcggtcttcccctggcgcctgctcc

SEQ ID NO: 463287 - DNA, 476 bp, Homo sapiens
  misc_feature: HEFZJCU01AEH6P.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctctgggggcacagcggccctgggctgcctggtcaaggactactccgagtagtaca

SEQ ID NO: 463288 - DNA, 480 bp, Homo sapiens
  misc_feature: HEFZJCU01EUK56.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctctgggggcacagcggcctgggctgcctggtcaaggactactcctagagacacg

SEQ ID NO: 463289 - DNA, 484 bp, Homo sapiens; identical to SEQ ID NO: 446564
  misc_feature: HEFZJCU01CT3Q7.19.13.B02.1.454.heavy.3.raw

SEQ ID NO: 463290 - DNA, 515 bp, Homo sapiens
  misc_feature: HEFZJCU01CJRJH.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccattttatttctgtgcgaaggaggcatatgggaagtacgattttcgatccctcgcagtcgacactttgattactggggccggggaaccctggtcgccgtctcctcagcctccaccaagggcccatcggtcttcccctggcaccctcctccaagagcacctctgggggcacagcggcctggctgcctggtcaaggctacttccagacgtatca

SEQ ID NO: 463291 - DNA, 396 bp, Homo sapiens; identical to SEQ ID NO: 444469
  misc_feature: HEFZJCU01DUCA3.47.46.E02.1.454.heavy.3.raw

SEQ ID NO: 463292 - DNA, 519 bp, Homo sapiens
  misc_feature: HEFZJCU01CP2VS.49.28.C06.1.454.heavy.3.raw
  modified_base (503)..(503): a, c, t, g, unknown or other
  modified_base (509)..(509): a, c, t, g, unknown or other
agtcgagagacacgaccggtgctcgatttagagctcacgtattgggtttggggacccaacaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcaacggtcgtcatgggatttgactactggggccaggggaaccccgtnaccgtntcctctgcct

SEQ ID NO: 463293 - DNA, 490 bp, Homo sapiens
  misc_feature: HEFZJCU01BXO6Q.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccagacaaggggctagagtgggtggcggtcatatcgtccagtggacatcttcagtattacggcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctccgagagcacagcggccctgggctgcctggtcaaggactacttcctacgtgagct

SEQ ID NO: 463294 - DNA, 506 bp, Homo sapiens; identical to SEQ ID NO: 446520
  misc_feature: HEFZJCU01ANXTG.10.38.D05.1.454.heavy.3.raw

SEQ ID NO: 463295 - DNA, 409 bp, Homo sapiens
  misc_feature: HEFZJCU01BWOXT.3.41.D08.1.454.heavy.3.raw
agacgcactccacgaccggtgctcgatttagtcacgcgagaaagggaaaggggctggaatgggttgcatacatttcaagtattggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactggggccaggggaccctggtcaccgtctcctcagcttccaccaagggcccatcggtcttccccctggcgccctgctccaggagcacctctgggggcacagcggccctgggctgcctggtcaaggactacttccgagtgcgtct

SEQ ID NO: 463296 - DNA, 505 bp, Homo sapiens; identical to SEQ ID NO: 445474
  misc_feature: HEFZJCU01EY4RA.16.34.D01.1.454.heavy.3.raw

SEQ ID NO: 463297 - DNA, 492 bp, Homo sapiens
  misc_feature: HEFZJCU01CQ3GK.48.59.F04.1.454.heavy.3.raw
agtatacatacacgaccggtgctcgatttagtacacacacttagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgcagcccccaggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgccttgatatgtgggccaagggacaat

SEQ ID NO: 463298 - DNA, 502 bp, Homo sapiens; identical to SEQ ID NO: 451203
  misc_feature: HEFZJCU01AOT9J.10.38.D05.1.454.heavy.3.raw

SEQ ID NO: 463299 - DNA, 524 bp, Homo sapiens
  misc_feature: HEFZJCU01C40W8.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggccaggggaccctggtcatcgtctccccagccctccaccaagggcccatcggtcttcccctggccg

SEQ ID NO: 463300 - DNA, 500 bp, Homo sapiens; identical to SEQ ID NO: 444529
  misc_feature: HEFZJCU01D8S4N.12.38.D05.1.454.heavy.3.raw

SEQ ID NO: 463301 - DNA, 513 bp, Homo sapiens
  misc_feature: HEFZJCU01D1CIE.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatccctccgggacagacttaccatgaccacgaactcctccataaacacagcctacatggagttgaggagcctgacatctgacgacacggccgtctattactgtgcgagagtcccacgatccggtgacgcctacggcagcggcctttgactttcgtggggccaggggacg

SEQ ID NO: 463302 - DNA, 510 bp, Homo sapiens
  misc_feature: HEFZJCU01D8CR8.9.78.H01.1.454.heavy.3.raw
tgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctgggtcaccgtctcctcagcctccaccaagggcccatcggtcttccccctggcgccctgctccaggagcacctccgagagcacagcggccctgggctgcctggtcaaggactacttccagacgtatca

SEQ ID NO: 463303 - DNA, 532 bp, Homo sapiens
  misc_feature: HEFZJCU01A8WOB.16.87.H10.1.454.heavy.3.raw
tgtactactccacgaccggtgctcgatttagcagtactgcgttgggtttgggggccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggataatttagcctacgcggactccgtcaagggccgattcaccgtctccagagacaacaccaagaacacactatatctgcagattgacagtctgagacccgaggacacggctgtgtattactgtgcaaggcagttcgtggaaacagttatgggttggggggagttggggttttttttcgtacgttacgggattc

SEQ ID NO: 463304 - DNA, 500 bp, Homo sapiens
  misc_feature: HEFZJCU01CJMGK.51.83.H06.1.454.heavy.3.raw
cgatcgtatacacgaccggtgctcgatttagatcacgtgcgtcgcggggctgggagacgagcccagcactggaagtcgccggtgtttccattcggtgatcatcactgaacacagaggactcaccatggagtttgggctgagctgggttttcctcgttagctcttttaagaggtgtccagtgtcaggtgcagctggtggactctgggggaggcgtggtccagcctgggaggtccctgcgactctcctgtgcagcctctggattcagcttcagggctaatactatgttctgggtgcgccaggctccaggcaaggggctggagtgggtggcagtcatctggcctgatggaggtttaacatactatgcggactccgtggagggccgattcaccgtctccagagacaactccaaaacacgctgtatctccaaatgaacagcctcagatctgaggacacggctatctactactgtgtgaaagaattgggtttcagtggctactttt

SEQ ID NO: 463305 - DNA, 509 bp, Homo sapiens
  misc_feature: HEFZJCU01D4W3D.7.71.G05.1.454.heavy.3.raw
  modified_base (496)..(496): a, c, t, g, unknown or other
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggagggggaacagcggagttcagtactcttnacgtctgggccac

SEQ ID NO: 463306 - DNA, 506 bp, Homo sapiens
  misc_feature: HEFZJCU01DE3VY.13.23.C01.1.454.heavy.3.raw
tcacgtactacacgaccggtgctcgatttagtacacgtgattagggattgggggaggcgtggtccagcctggggaatccctgacactgtcttgtgtagcctctggattcagcttcagaacctatggcatgcactgggtccgccaggccccaggcaaggggctggagtggctgactcttttatcatatgatggaagtcaaaattctatgcagactccgtgaagggccgattcaccgtctccagggacaactccaagaacaccttatatctgcagatgaacagcctgagaggtgacgactcggctgtatacttctgtgcgacaaacatgatgtttggagtggatgtgtacttctaccactacggaatggacgtctggggccaagggaccgcggtcaccgtctcctcagcctccaccaagggcccatcggtcttcccctggcaccctcctccaagagcacctctggggcacagcgcctgggctgcctggtcaaggactacttcctagta

SEQ ID NO: 463307 - DNA, 502 bp, Homo sapiens
  misc_feature: HEFZJCU01CCB3V.9.81.H04.1.454.heavy.3.raw
tgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttccttttgggtattttaaaaggtgtccagtgtgaagtgcagctggtggagtctgggggaggcttggtgcagcctggcacctccctgagactctcctgtgccgcctctggattcatgtttgatgattatgccatgcactgggtccggcaagttccagggaaggcctggagtgggtctcaggtattacttggagtagcactaccacaggctatgcggactctgtgaggggccgattcaccatctccagagacaacgccaagaactccctatatctgcaaatgaatggtctgagagttgaggacacggccttgtattactgtgacaaaagataggaaacccaggtggacgc

SEQ ID NO: 463308 - DNA, 511 bp, Homo sapiens
  misc_feature: HEFZJCU01EV97C.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagccctgagagccgatgacacggccgtgtattactgtgcgagagatggggccacgaacgttactacgctatggacgtctgggg

SEQ ID NO: 463309 - DNA, 476 bp, Homo sapiens; identical to SEQ ID NO: 462647
  misc_feature: HEFZJCU01AV933.12.5.A05.1.454.heavy.3.raw

SEQ ID NO: 463310 - DNA, 500 bp, Homo sapiens
  misc_feature: HEFZJCU01ENS9B.10.71.G05.1.454.heavy.3.raw
catagtagtgcacgaccggtgctcgatttagtgtcgtcgcaagagagagggggtctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttcaaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatcctagtggcatctaccg

SEQ ID NO: 463311 - DNA, 516 bp, Homo sapiens
  misc_feature: HEFZJCU01DPP1R.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctcgcagtcgacactttgattactggggccggggaaccctggtcgccgtctcctcagcctccaccaagggcccatcggtcttcccctggcaccctcctccaagagcacctctgggggcacagcggccctggctgcctggtcaaggactacttccagacgtatca

SEQ ID NO: 463312 - DNA, 528 bp, Homo sapiens
  misc_feature: HEFZJCU01CY5VT.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtccttcccctggccgcctcg

SEQ ID NO: 463313 - DNA, 530 bp, Homo sapiens; identical to SEQ ID NO: 455130
  misc_feature: HEFZJCU01E0PAU.7.78.H01.1.454.heavy.3.raw

SEQ ID NO: 463314 - DNA, 519 bp, Homo sapiens; identical to SEQ ID NO: 444867
  misc_feature: HEFZJCU01DXRVW.9.34.D01.1.454.heavy.3.raw

SEQ ID NO: 463315 - DNA, 521 bp, Homo sapiens
  misc_feature: HEFZJCU01EGLKH.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaatgaacagcctgagagccgatgacacggccgtgtattactgtgcgagagagtggggcccacgaacgttactacgctatggacgtcgtggggccgaagggaccg

SEQ ID NO: 463316 - DNA, 533 bp, Homo sapiens
  misc_feature: HEFZJCU01ADWUA.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatctatgggggcttgttctggggccaggggaccctggtcatcgtctccccagccctccaccgaacgggcccatccggtccttccccgtggccgccctcg

SEQ ID NO: 463317 - DNA, 515 bp, Homo sapiens
  misc_feature: HEFZJCU01C8JLY.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattccaccatctccagagacttttctcagaacacactgtctcttcaaatgaacagcctgagggccgaggacacggccgtctattattgtgtgagagtttatggcgatggctggtggacagatcactggggccaac

SEQ ID NO: 463318 - DNA, 502 bp, Homo sapiens
  misc_feature: HEFZJCU01EEX5P.53.54.E10.1.454.heavy.3.raw
cgcgtatacacacgaccggtgctcgatttagatcgtagcagaacacacaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtccgggggaggcgtggtccagcctgggaggtccctgagactctcctgtgtagcctctggattcaccttcagggtctatggcatgaactgggtccgccagactccaggcaaggggctggagtgggtggcatttatatcatttgatggcactaataaatactatgcagactccgtgaggggccgattcaccatctccagagacaattccaagaacatggtgttctgcaaatgaacagcctgagagttgaagacacggctgtgtattactgtgcgaaacggaatgagtgggaactagggg

SEQ ID NO: 463319 - DNA, 510 bp, Homo sapiens
  misc_feature: HEFZJCU01EP037.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctggccaccctcctccaagagcacctcgtgggggcacagccggcccgtgggctgcctggtcaaggactacttccgagtagtaca

SEQ ID NO: 463320 - DNA, 518 bp, Homo sapiens
  misc_feature: HEFZJCU01C1IOJ.10.59.F04.1.454.heavy.3.raw
catagtagtgcacgaccggtgctcgatttagtacacacacttagggattgggggctttctgagagtcatggacctcctgtgcaagaacatgaatcacctgtggttcttcctcctgctggtggcggcccccagatgggtcctgtcccagctgcagctgcatgagtcgggcccaggactggtgaggccttcggataccctgtccctcagttgcgctgtctctggtggctccatcaacagtggtgacaactggtggggctgggtccgccagcccccagggatgggactggagtggattggccttacacattatagtgggactacccactacaacccgtccctcaggagtcgagtcaccatctcactagacacgtccaggaatcacctctccctgacggtgacctctgtgaccgccgcggacacggccgtgtattattgtgcgagagaccccgctgaagattcctcaatgtactttgacctactggggccaggggagccctgggtccaccgtctcctcgacg

SEQ ID NO: 463321 - DNA, 506 bp, Homo sapiens
  misc_feature: HEFZJCU01DSZGJ.48.35.D02.1.454.heavy.3.raw
agtatacatacacgaccggtgctcgatttagcacacgatagttgggtttggggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggcccgagcgcagtggcttttgatgcctttgatatgtgggccaagggacaatggtcaccgtctcttcagcctccaccaaggg

SEQ ID NO: 463322 - DNA, 529 bp, Homo sapiens
  misc_feature: HEFZJCU01C4HSK.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtcttcccctggtcgcctgctccacggagcacctccgagagcacagcggcccgtcgggcg

SEQ ID NO: 463323 - DNA, 479 bp, Homo sapiens
  misc_feature: HEFZJCU01C7LVZ.26.78.H01.1.454.heavy.3.raw
agactatactcacgaccggtgctcgatttagtgtgagtagtttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagttactatactatgcactgggtccgccaggctccaggcaaggggctggagtgggtggcagttatatcatatgatggaagcagcacatattacacagactccgtgaagggccgattcaccatctccagagacaatttgaagaacacgctgtatctgcaaatgaacagcctgagagctgaagacacggctgtgtttttactgtgcgagagaga

SEQ ID NO: 463324 - DNA, 387 bp, Homo sapiens; identical to SEQ ID NO: 445893
  misc_feature: HEFZJCU01A9J17.9.53.E09.1.454.heavy.3.raw

SEQ ID NO: 463325 - DNA, 525 bp, Homo sapiens; identical to SEQ ID NO: 446745
  misc_feature: HEFZJCU01D7Y1Y.7.70.G04.1.454.heavy.3.raw

SEQ ID NO: 463326 - DNA, 519 bp, Homo sapiens
  misc_feature: HEFZJCU01CDYTQ.14.57.F02.1.454.heavy.3.raw
cgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtattttgtgttgaaagatacgaagtctatgatacccaatttggaggggctttcat

SEQ ID NO: 463327 - DNA, 484 bp, Homo sapiens
  misc_feature: HEFZJCU01EK6OL.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctggcgccctgctccaggagcacctccgagagcacacgcggccctgggctgcctggtcaaggactacttcccactactatg

SEQ ID NO: 463328 - DNA, 508 bp, Homo sapiens; identical to SEQ ID NO: 444619
  misc_feature: HEFZJCU01EJNWL.3.81.H04.1.454.heavy.3.raw

SEQ ID NO: 463329 - DNA, 401 bp, Homo sapiens
  misc_feature: HEFZJCU01EXLLB.14.60.F05.1.454.heavy.3.raw
cgtctagtaccacgaccggtgctcgatttagtacgtcatcagggaaagggctggagtgggttggccgtattaagagtaaagctaacaattacgcgacagtatatgctgcgtcggtgaaaggcaggttcaccatctccagagatgattcagagaacacggcgtatctgcaaatgaacagcctgaaaaccgaggacacggccgtgtattattgtactagaccgtcttacgatattttgactggtcggcgggggttcgacccctggggccagggaaccctggtcaccgtctcctcagcttccaccaagggcccatcggtcttccccctggcgccctgctccaggagcacctctggggcacagcggccctggctgcctggtcaaggactacttccgtactagacg

SEQ ID NO: 463330 - DNA, 528 bp, Homo sapiens
  misc_feature: HEFZJCU01E1BDE.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaa

SEQ ID NO: 463331 - DNA, 491 bp, Homo sapiens; identical to SEQ ID NO: 446104
  misc_feature: HEFZJCU01EB1T7.3.34.D01.1.454.heavy.3.raw

SEQ ID NO: 463332 - DNA, 519 bp, Homo sapiens
  misc_feature: HEFZJCU01CQYPN.17.33.C11.1.454.heavy.3.raw
  modified_base (491)..(491): a, c, t, g, unknown or other
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttatagtccctatttgactactgggccaggggaactcgtggttcacccgtntcccgcagcctccaccaagggcccatcc

SEQ ID NO: 463333 - DNA, 521 bp, Homo sapiens
  misc_feature: HEFZJCU01DOB28.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacgggccgtctattattgtgtgagagtttatggcgattgggctgggtggacaggatcacgtgggggcccaa

SEQ ID NO: 463334 - DNA, 539 bp, Homo sapiens
  misc_feature: HEFZJCU01DFNT8.17.28.C06.1.454.heavy.3.raw
cgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacactgaacagcctgagagtcgcagacacggccgtgtattactgtgcgagatgtaggaaaaagtatggctgtgtttattgggggccagggggacgccctgggtccaccggtt

SEQ ID NO: 463335 - DNA, 505 bp, Homo sapiens; identical to SEQ ID NO: 447076
  misc_feature: HEFZJCU01BSEH6.10.38.D05.1.454.heavy.3.raw

SEQ ID NO: 463336 - DNA, 483 bp, Homo sapiens; identical to SEQ ID NO: 444532
  misc_feature: HEFZJCU01AGQCE.47.59.F04.1.454.heavy.3.raw

SEQ ID NO: 463337 - DNA, 527 bp, Homo sapiens
  misc_feature: HEFZJCU01CVMHD.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtctttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacggctgtttattactgtgcgcggtggctgaccgctcttgactactggggccgggagccccggtcatcgtctcc

SEQ ID NO: 463338 - DNA, 513 bp, Homo sapiens
  misc_feature: HEFZJCU01BW1Q2.14.61.F06.1.454.heavy.3.raw
cgtctagtaccacgaccggtgctcgatttagctacgctctaagggaaaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagatgcctggggcctcagttgaggtctcctgcaggacttctggttacacctttaccaactatggtatcacctgggtgcggcaggtcccaggacaagggcttgagtggctgggatggatcagcggtttcgatgagaaaccagttctgcacaaaagttccagggcagactcaccctgactacagacgcatcaacgggctcagccttcatgaccctgaggaacctgagacctgacgacgcggccatctattactgtgcgagagatgggtggcagctcgtctcaggaattgacttctggggcccgggaacctgatcaccg

SEQ ID NO: 463339 - DNA, 379 bp, Homo sapiens; identical to SEQ ID NO: 444450
  misc_feature: HEFZJCU01D56EY.47.77.G11.1.454.heavy.3.raw

SEQ ID NO: 463340 - DNA, 490 bp, Homo sapiens
  misc_feature: HEFZJCU01EP56X.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctggtcaagactacttccgtatctctcg

SEQ ID NO: 463341 - DNA, 520 bp, Homo sapiens
  misc_feature: HEFZJCU01DNZFQ.10.79.H02.1.454.heavy.3.raw
  modified_base (507)..(507): a, c, t, g, unknown or other
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcncctggttattacc

SEQ ID NO: 463342 - DNA, 496 bp, Homo sapiens
  misc_feature: HEFZJCU01BN94K.12.75.G09.1.454.heavy.3.raw
atacgacgtacacgaccggtgctcgatttagtatagacatcaggggccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattaccgcggacgaatccacgaccacagcctacatagagctgcgcagcctgagatctgaagacacggccatttattactgtgcgagagatgcagggccctcccacatcggttattttcgtttgacttcctggggcccgagggaaccctggtccaccgtctcct

SEQ ID NO: 463343 - DNA, 522 bp, Homo sapiens
  misc_feature: HEFZJCU01A9HW5.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctgggccagggaaccctggtcaccgtctcctcagcctccaccaacgggcccatcggtcttccccctggccaccctcctccaagagcacctctgggggcacagcggccctgggctgcctggtcaaggactacttccgagtagtactac

SEQ ID NO: 463344 - DNA, 501 bp, Homo sapiens; identical to SEQ ID NO: 447123
  misc_feature: HEFZJCU01A3G7Z.3.20.B09.1.454.heavy.3.raw

SEQ ID NO: 463345 - DNA, 523 bp, Homo sapiens
  misc_feature: HEFZJCU01CFVKV.47.46.E02.1.454.heavy.3.raw
agctcacgtacacgaccggtgctcgatttagactcatctacagggaaagggggagagaggagcccagccctgggattttcaggtgttttcatttggtgatcaggactgaaccgagagaactcaccatggagtttgggctgagctggctctttcttgtggcttttttaaaaggtgtccagtgtgaggtgcaactgttggagtctgggggagacttagtacaccctggggggtccctgagactctcctgtgcagcctctggactcacctttagcaactctgtcatgggctgggtccgccaggctccggggaagggctggagtgggtctcaagtattgatgagaatggtggaagcacattctacgtggactccgtgaagggccggttcaccatctccagagacaatttcaggagcacgctgtatctacaaatgaacagcctgagagccggaggacacggccgtatattctgtgcgaaagtctatagcagtcgcccctacgcgcacttctttgacttcgtggggcca

SEQ ID NO: 463346 - DNA, 505 bp, Homo sapiens; identical to SEQ ID NO: 446090
  misc_feature: HEFZJCU01AZYCX.52.53.E09.1.454.heavy.3.raw

SEQ ID NO: 463347 - DNA, 520 bp, Homo sapiens
  misc_feature: HEFZJCU01DO631.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagaccctccgatagcagtggctggtccactaggtttgactactgggggccagggaagcttggtcaccgtctcctcagcct

SEQ ID NO: 463348 - DNA, 500 bp, Homo sapiens; identical to SEQ ID NO: 446033
  misc_feature: HEFZJCU01D67TI.11.27.C05.1.454.heavy.3.raw

SEQ ID NO: 463349 - DNA, 477 bp, Homo sapiens; identical to SEQ ID NO: 446049
  misc_feature: HEFZJCU01DPSUP.16.10.A10.1.454.heavy.3.raw

SEQ ID NO: 463350 - DNA, 497 bp, Homo sapiens; identical to SEQ ID NO: 445179
  misc_feature: HEFZJCU01BZ9AM.12.55.E11.1.454.heavy.3.raw

SEQ ID NO: 463351 - DNA, 517 bp, Homo sapiens
  misc_feature: HEFZJCU01A61PJ.11.25.C03.1.454.heavy.3.raw
cgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagagtggggcccacggaacgttactacgctatggacgtcgtggggcc

SEQ ID NO: 463352 - DNA, 487 bp, Homo sapiens
  misc_feature: HEFZJCU01AHUCT.49.17.B06.1.454.heavy.3.raw
agtcgagagacacgaccggtgctcgatttagtcgatagtgaaggggtctgggagacgagcccagcactggaagtcgccggtgtttccattcggtgatcatcactgaacacagaggactcaccatggagtttgggctgagctgggttttcctcgttgctcttttcagaggtgtccagtgttatgtgcagctggtggagtctgggggaggcgtggtccagcctgggaggtccctgagactcgcctgcaaaccgtccggattcaccttcagtaattatgcaatgcactgggtccgccagactccaggcaaggggctgcactgggtggcggccatatcatttgatggaagcaagaaatactatgcagactccgtgaggggccgattcatcatctccagagacagttccgatgacacagtgtatctgcaaatgaaacagcctgagacctgaggacacggctctcttttactgtgcgccaggaagcagtggct

SEQ ID NO: 463353 - DNA, 410 bp, Homo sapiens
  misc_feature: HEFZJCU01B8YEY.49.14.B03.1.454.heavy.3.raw
agtcgagagacacgaccggtgctcgatttagtgtgagtagttcgcgggcacgaccggtgctcgatttagtgtgctacgaagggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatccctggtcatcgtctcctcagcctccaccaagggcccatcggtcttccccctggcgccctgctccaggagcacctccgagagcacagcggccctgggctgcctggtcaaggactacttcctctctcgact

SEQ ID NO: 463354 - DNA, 482 bp, Homo sapiens; identical to SEQ ID NO: 444904
  misc_feature: HEFZJCU01CVL61.47.59.F04.1.454.heavy.3.raw

SEQ ID NO: 463355 - DNA, 516 bp, Homo sapiens
  misc_feature: HEFZJCU01CYGPJ.11.13.B02.1.454.heavy.3.raw
cgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctcg

SEQ ID NO: 463356 - DNA, 513 bp, Homo sapiens
  misc_feature: HEFZJCU01AU6YR.4.23.C01.1.454.heavy.3.raw
agcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatgcacagacgttccagggcagagtcaccattaccacagacacatccacgagcacagcctacatggacctgaggagcctgagatttgacgacacggccatatattactgtgcgagagattggggccgacggaaaccttgactactggggccagggaaccctggtcaccggt

SEQ ID NO: 463357 - DNA, 532 bp, Homo sapiens
  misc_feature: HEFZJCU01C43EV.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaacccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctcacctaaggg

SEQ ID NO: 463358 - DNA, 499 bp, Homo sapiens; identical to SEQ ID NO: 446805
  misc_feature: HEFZJCU01CHKK1.3.20.B09.1.454.heavy.3.raw

SEQ ID NO: 463359 - DNA, 437 bp, Homo sapiens; identical to SEQ ID NO: 444603
  misc_feature: HEFZJCU01DDRQO.3.21.B10.1.454.heavy.3.raw

SEQ ID NO: 463360 - DNA, 510 bp, Homo sapiens
  misc_feature: HEFZJCU01ARFF6.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctaattactgtgcgagagactacggtgaccttttctggtatttcgatctctggggccgtggcaccctggtcactgtctcctcggcttccaccaagggccatcggtcttcccctggcgcctgctccagagcacctctggggcacagcggccg

SEQ ID NO: 463361 - DNA, 508 bp, Homo sapiens; identical to SEQ ID NO: 445594
  misc_feature: HEFZJCU01C1X8B.17.25.C03.1.454.heavy.3.raw

SEQ ID NO: 463362 - DNA, 513 bp, Homo sapiens; identical to SEQ ID NO: 453958
  misc_feature: HEFZJCU01EVGSP.15.67.G01.1.454.heavy.3.raw

SEQ ID NO: 463363 - DNA, 480 bp, Homo sapiens; identical to SEQ ID NO: 446171
  misc_feature: HEFZJCU01EXMZP.22.36.D03.1.454.heavy.3.raw

SEQ ID NO: 463364 - DNA, 474 bp, Homo sapiens
  misc_feature: HEFZJCU01DKUCB.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgaccctggggccagggaaccctggtcaccgtctcctcagcctccaccaagggcccatcggtcttcccctggcaccctcctccaagagcacctctgggggcacagcggcctgggctgcctggtcaaggactacttccgagtagtaca

SEQ ID NO: 463365 - DNA, 529 bp, Homo sapiens
  misc_feature: HEFZJCU01DAQVQ.13.38.D05.1.454.heavy.3.raw
tcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtctggggggggcttggttaagcctggggggtccctcagactctcctgtgcaacctctggattcattttctctgacgcctggttgagctgggtccgccaggctcccgggaaggggctggagtgggttggccgtattaaaggtagaagacatggtcggacaacagactacagtgttcccgtgaaaggcagattcactatctcaagagatgactcaaaagaaatgatatatctgcaatgaacaacctgaaaagcgaggacacaggacgtgtattactgtaccacagatgggccagatgacaaatggccgcgacgagtttcgactactc

SEQ ID NO: 463366 - DNA, 507 bp, Homo sapiens
  misc_feature: HEFZJCU01C4834.48.44.D11.1.454.heavy.3.raw
  modified_base (387)..(387): a, c, t, g, unknown or other
agtatacatacacgaccggtgctcgatttagcgcagtacgaagggaggcttggtccagcctgggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcnccgtctcctcagcctccaccaagggcccatcggtcttcccctggcgccctgctccaggagcacctccgagagcacagcggccctgggctgcctggtcaaggactacttcctatgtatact

SEQ ID NO: 463367 - DNA, 482 bp, Homo sapiens; identical to SEQ ID NO: 451792
  misc_feature: HEFZJCU01CNNTM.19.71.G05.1.454.heavy.3.raw

SEQ ID NO: 463368 - DNA, 499 bp, Homo sapiens
  misc_feature: HEFZJCU01EJH7R.51.78.H01.1.454.heavy.3.raw
cgatcgtatacacgaccggtgctcgatttagtgtgagtagtttgggtttgggggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttccccctcggcaccctcctccaagagcacctctgggggcacagcggccctgggctgcctggtcaaggactacttcctcgtagcact

SEQ ID NO: 463369 - DNA, 506 bp, Homo sapiens
  misc_feature: HEFZJCU01CJVJZ.48.73.G07.1.454.heavy.3.raw
agtatacatacacgaccggtgctcgatttagctctacgctcagggcacgaccggtgctcgatttagagagagtgtgttgggtttggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcct

SEQ ID NO: 463370 - DNA, 533 bp, Homo sapiens
  misc_feature: HEFZJCU01DHG74.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaaccaggtggtccttacaatgaccaccatggaccctgtggacacagccacatatttctgtgcacactctataggagcacctggtagtctgccaaactggttcgacccctggggcccggaaccctggtcaccgtctcctcagcctccaccaagggcccatcggtcttcccctc

SEQ ID NO: 463371 - DNA, 490 bp, Homo sapiens; identical to SEQ ID NO: 446494
  misc_feature: HEFZJCU01B349G.11.13.B02.1.454.heavy.3.raw

SEQ ID NO: 463372 - DNA, 526 bp, Homo sapiens
  misc_feature: HEFZJCU01EPDZS.47.6.A06.1.454.heavy.3.raw
agctcacgtacacgaccggtgctcgatttagatctactgacagcacacaagggggggaaatactttctgagagtcctggacctcctgtgcaagaacatgaaacatctgtggttcttccttctcctggtggcagctcccacatgggtcctgtcccaggtgcagctgcaggagtcgggcccaggactggtgaagccttcggagaccctgtccctcacttgcactgtctctggtggctccatcaggagttactactggacctggcttcggcagtccccagggaagggactggagtggattgggtataattattacagtgggaccaccaactacaacccctccctcaagagtcgagtcaccatatcaatagacacgtcgaagaaccagttctccctgaagttgaactcagtgaccgctgcggacacggccgtgtattactgtgcgagccacaccgattacgattttggagtggccttgataacgtggggccgaggggatcctggtcaccgtctcctcagcctccaccaac

SEQ ID NO: 463373 - DNA, 390 bp, Homo sapiens; identical to SEQ ID NO: 444541
  misc_feature: HEFZJCU01EXJ3S.16.24.C02.1.454.heavy.3.raw

SEQ ID NO: 463374 - DNA, 488 bp, Homo sapiens; identical to SEQ ID NO: 459700
  misc_feature: HEFZJCU01APBW9.47.85.H08.1.454.heavy.3.raw

SEQ ID NO: 463375 - DNA, 308 bp, Homo sapiens
  misc_feature: HEFZJCU01BQ9AR.49.38.D05.1.454.heavy.3.raw
agtcgagagacacgaccggtgctcgatttagtatctgatagttgggtttgggcacgaccggtgctcgatttagtatctgatagttgggttttggggggaagaggaagactgacggtcctcccaggagttcaggtgctgggcaccgtgggcatgggggaggtgtgtcacaagatttgagccctggtcaccgtctcctcagcttccaccaagggcccatcggtcttccccctggcgccctgctccaggagcacctctgggggcacagcggccctgggctgcctggtcaaggactacttcctctctcgact

SEQ ID NO: 463376 - DNA, 520 bp, Homo sapiens; identical to SEQ ID NO: 447654
  misc_feature: HEFZJCU01ATMF0.10.79.H02.1.454.heavy.3.raw

SEQ ID NO: 463377 - DNA, 504 bp, Homo sapiens
  misc_feature: HEFZJCU01BH9QF.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgactcgtgacgacacggccatgtattactgtggaagaggacgttggtggctaccggcggggctggaccacgtggggccg

SEQ ID NO: 463378 - DNA, 402 bp, Homo sapiens; identical to SEQ ID NO: 444815
  misc_feature: HEFZJCU01DBJJ9.11.70.G04.1.454.heavy.3.raw

SEQ ID NO: 463379 - DNA, 419 bp, Homo sapiens; identical to SEQ ID NO: 459293
  misc_feature: HEFZJCU01EG1C4.4.22.B11.1.454.heavy.3.raw

SEQ ID NO: 463380 - DNA, 524 bp, Homo sapiens
  misc_feature: HEFZJCU01D96YE.48.26.C04.1.454.heavy.3.raw
agtatacatacacgaccggtgctcgatttagtctagcgactttgggtttggggggaagaggaagactgacggtccccccaggagttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagaagggtttactatggttcggggagtctccgacccagcaactggttcgaccctggggccagggaaccctggtcaccgtctcctcagcctccaccaaggccatcggtcttcccctggcaccctcctccaagagcacctctggggcacacgg

SEQ ID NO: 463381 - DNA, 526 bp, Homo sapiens; identical to SEQ ID NO: 448857
  misc_feature: HEFZJCU01DHO9K.7.70.G04.1.454.heavy.3.raw

SEQ ID NO: 463382 - DNA, 497 bp, Homo sapiens; identical to SEQ ID NO: 445179
  misc_feature: HEFZJCU01AMVOT.12.55.E11.1.454.heavy.3.raw

SEQ ID NO: 463383 - DNA, 488 bp, Homo sapiens; identical to SEQ ID NO: 444740
  misc_feature: HEFZJCU01CCMYQ.18.70.G04.1.454.heavy.3.raw

SEQ ID NO: 463384 - DNA, 409 bp, Homo sapiens; identical to SEQ ID NO: 444519
  misc_feature: HEFZJCU01AKY33.3.41.D08.1.454.heavy.3.raw

SEQ ID NO: 463385 - DNA, 492 bp, Homo sapiens
  misc_feature: HEFZJCU01EO3OG.51.35.D02.1.454.heavy.3.raw
cgatcgtatacacgaccggtgctcgatttagcacacgatagttgggtttggggacccaaaaaccacacccctccttgggagaatcccctagatcacagctcctcaccatggactggacctggagcatccttttcttggtggcagcagcaacaggtgcccactcccaggttcagctggtacagtctggagctgaagtgaagaagcctggggcctcagtgaaggtctcctgcaaggcctctggttacacctttatgaattatggtatcagctgggtgcgccaggcccctggacaagggcttgagtggatgggatggatcagcgcttacactggtgacacaaagtatgcacagaaactccagggcagagtcaccatgaccacagacacgtccacgagcacagcctacatggaactgaggagacctgggatctgacgacacggccgtgtattactgtgcgagagataggcccgagggagagtagtggttttcaccg

SEQ ID NO: 463386 - DNA, 504 bp, Homo sapiens
  misc_feature: HEFZJCU01DI75C.51.65.F10.1.454.heavy.3.raw
cgatcgtatacacgaccggtgctcgatttagctacgctctaagggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggattaattccaaaagtggtggcacaaagactgcacagaagtttcagggcagggtcaccatgaccagggacaagtccaaccaacacagcctacatggaactaagggactgacatctgacgacacggccatgtattattgtgcgagagaaatgttaggtactgcttggtccctggggcccgggaaccgggtc

SEQ ID NO: 463387 - DNA, 518 bp, Homo sapiens
  misc_feature: HEFZJCU01DG2RC.7.78.H01.1.454.heavy.3.raw
  modified_base (513)..(513): a, c, t, g, unknown or other
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccaagagcacctctgggggcacagcggccctgggctgcctggtcaaggactactcctaganacacg

SEQ ID NO: 463388 - DNA, 509 bp, Homo sapiens
  misc_feature: HEFZJCU01CPGXN.21.4.A04.1.454.heavy.3.raw
  modified_base (371)..(371): a, c, t, g, unknown or other
  modified_base (454)..(454): a, c, t, g, unknown or other
  modified_base (490)..(490): a, c, t, g, unknown or other
tcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctctgcattcaccttcagtgaccacaacatggactgggtccgccaggctccagggaagggctggagtgggtcgccgtattacaaggaaagctaacagttacagtacagaatacggcncgtctgtgaaaggaaggttcaccatctcaagagatgattcaaaagactcactgtatctgcaaatgaacagcctagaaaaccgnggacacggccgtagtattattgtggtagacaaaagngtaggatgtggtggtagct

SEQ ID NO: 463389 - DNA, 517 bp, Homo sapiens
  misc_feature: HEFZJCU01EZK3D.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttccccc

SEQ ID NO: 463390 - DNA, 526 bp, Homo sapiens
  misc_feature: HEFZJCU01CYVEG.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggccaggggaccctggtcatcgtctcccctagcctccaccaagggcccatccggtcttccccctggccg

SEQ ID NO: 463391 - DNA, 377 bp, Homo sapiens
  misc_feature: HEFZJCU01CC6M3.47.77.G11.1.454.heavy.3.raw
agctcacgtacacgaccggtgctcgatttagctagtcactcaagggaaagggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcgccctgggctgcctggtcaaggactacttcctacgtgagct

SEQ ID NO: 463392 - DNA, 379 bp, Homo sapiens
  misc_feature: HEFZJCU01EODSX.47.77.G11.1.454.heavy.3.raw
agctcacgtacacgaccggtgctcgatttagctagtcactcaagggaaaggggctggagtgggtctcagacattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 463393 - DNA, 522 bp, Homo sapiens
  misc_feature: HEFZJCU01BE65I.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatccgtcttccccctggcg

SEQ ID NO: 463394 - DNA, 526 bp, Homo sapiens
  misc_feature: HEFZJCU01C998I.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaatgaacagcctaagtcctgaggacgacgggtgtatactactgtacggaagggacggggggaaccaggcgggagttccaagtacctcctttgacgtcgtcggggccgtac

SEQ ID NO: 463395 - DNA, 520 bp, Homo sapiens
  misc_feature: HEFZJCU01DSMW1.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattcccaagaacacgctgttcttcaaatgaacagcctgagagccgatgacacggccgtgtattactgtgcgagagatggggcccacgaacgttactacgctatggacgtctggggaccaagggaccg

SEQ ID NO: 463396 - DNA, 513 bp, Homo sapiens
  misc_feature: HEFZJCU01D71AI.4.23.C01.1.454.heavy.3.raw
agcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatgcacagacgttccagggcagagtcaccattaccacagacacatccacgagcacagcctacatggacctgaggagcctgagatttgacgacacggccatatattactgtgcgagagattggggccgacggaaaccttgactacgtggggccagggaaccctggtcaccgt

SEQ ID NO: 463397 - DNA, 507 bp, Homo sapiens
  misc_feature: HEFZJCU01EYLPN.3.85.H08.1.454.heavy.3.raw
agacgcactccacgaccggtgctcgatttagtatcactcagtcgcgggggagctctgagagacggagcccagccctgggattttcaggtgttttcatttggtgatcaggactgaacagagagaactcaccatggagtttgggctgagcgtggcgttttcttagtggctattttaaaggtgtccagtgtgaggtgcagctggtggagtctgggggaggcttggtacagcctggggggtccctgagactctcctgtgcagcctctggattcacctttagtaattatgccatgagctgggtccgccaggctccagggaaggggctggagtgggtctcagctattagtgatcgtggtggtaacacatactacgcagactccgtgaagggccgcttcaccatctccagagacaattccaagaacacgctgcatctgcaaatgaacagcctgagagccgaggacacggccctttatactgtgcgaaaccaatcacgtataactgaactacgta

SEQ ID NO: 463398 - DNA, 540 bp, Homo sapiens
  misc_feature: HEFZJCU01CAADF.48.12.B01.1.454.heavy.3.raw
agtatacatacacgaccggtgctcgatttagtagtgtagattccgcgggggctttctgagagtcatggatctcatgtgcaagaaaatgaagcacctgtggttcttcctcctgctggtggcgtctcccagatgggtcctgtcccagctgcacctgcaggagtcgggcccaggactggtgaggccttcggagaccctgtccctcacctgcactgtctctggtgactccatcaacagtggtactttttactactggggctggatccgccagaccccagggaagggtctggagtggattgggagtgtctattctagtgggaacacccactacaatccgtccctcaagagtcgagtcgccatatccgtggacacgtccaagaacgagttctccctgaggttacaatcttgtgaccgccgcagacacggctgtatattactgtgcgagacgaccggggaagggggcttacgtatgggattcggggcggggaggttactacttttgacttactcgggggccaggggagtcctgggtcaccgtctcct

SEQ ID NO: 463399 - DNA, 513 bp, Homo sapiens
  misc_feature: HEFZJCU01CIW8P.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatgggagttgaggagcctgacatctgacgacacggccgtctattactgtgcgagagtcccacgatccggtgagcctacggcaggccggcctttgacttcgtggggccaggggacg

SEQ ID NO: 463400 - DNA, 511 bp, Homo sapiens
  misc_feature: HEFZJCU01C08WO.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctgtcaccgtctccgcagcctccacaacgggcc

SEQ ID NO: 463401 - DNA, 536 bp, Homo sapiens
  misc_feature: HEFZJCU01ESVYI.17.28.C06.1.454.heavy.3.raw
  modified_base (523)..(523): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtatggctgtgtttattggggccagggganccctggtctaccg

SEQ ID NO: 463402 - DNA, 520 bp, Homo sapiens
  misc_feature: HEFZJCU01C9Z89.13.25.C03.1.454.heavy.3.raw
tcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacagtccggggctgaggtgaagaagcctggggcctcagtgaaggtctcctgcaaggcttccggatacaccctcaatggaaactatgtccactatgtgcgacaggccccaggacaagggcttctgtggatggggtggatcaaccctaatagtggtgacacaaactatgagaagaaatttgagggccgggtcaccatgaccagggacacgtccatcaatacagccttcatggaactgaccagactgacctctgacgacacggccgtgtattactgtgcggtcgaaactcagcctaactacttgaattttggggcctagggagcctggtcaccgtct

SEQ ID NO: 463403 - DNA, 525 bp, Homo sapiens
  misc_feature: HEFZJCU01CMH0A.48.4.A04.1.454.heavy.3.raw
agtatacatacacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaatcaatcatggtggatacaccaactacaacccgtccctcaagagccgagtcaccatcttagtggacacggcgaagaaccagttctccctgaaactgaccgctgtgaccgccgcggacacggctgtgtattactgtgcgagacgaatgggcgggtggctacgacttgacttttggggccagggaaacctggtcaccgtctccccagcttccaccagggcccatccggtcttcccccg

SEQ ID NO: 463404 - DNA, 504 bp, Homo sapiens
  misc_feature: HEFZJCU01DVO1R.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaacctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggccagcggcctttgacttcgtc

SEQ ID NO: 463405 - DNA, 507 bp, Homo sapiens; identical to SEQ ID NO: 444486
  misc_feature: HEFZJCU01BU0WE.4.67.G01.1.454.heavy.3.raw

SEQ ID NO: 463406 - DNA, 513 bp, Homo sapiens
  misc_feature: HEFZJCU01BKXY9.48.81.H04.1.454.heavy.3.raw
agtatacatacacgaccggtgctcgatttagtagtgtagattcgcgggggcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaaatcacacttaccgcggacaaatccacgggcacagcgcagttggacctgagcggcctgagacctgaggacacggccatttactactgtgcgcggggaggtggacggagctcggttttcggagttatcatctacttactttgtaacg

SEQ ID NO: 463407 - DNA, 490 bp, Homo sapiens
  misc_feature: HEFZJCU01EBXL5.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggccatcggtcttcccctggcaccctcctccaagagcacctctgggggcacagcggccctgggctgcctggtcaaggactacttccgagtgcgtct

SEQ ID NO: 463408 - DNA, 528 bp, Homo sapiens
  misc_feature: HEFZJCU01B95G8.21.78.H01.1.454.heavy.3.raw
tcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaatgaataacctgagagccgaggacacggccatgtattactgtgtggggcatttacttgaccctggggccgggaacccgtggcaccgtctccccaccctccaccaac

SEQ ID NO: 463409 - DNA, 502 bp, Homo sapiens
  misc_feature: HEFZJCU01C5I9H.53.53.E09.1.454.heavy.3.raw
cgcgtatacacacgaccggtgctcgatttagagagagtgtgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgaccctggggccagggaacctggtcaccgtctcctcagcttccaccaagggcccatcggtcttcccctggcg

SEQ ID NO: 463410 - DNA, 511 bp, Homo sapiens
  misc_feature: HEFZJCU01EPAN8.8.34.D01.1.454.heavy.3.raw
ctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaaggaggggggaaccaggcgggagttccaagtactcctttg

SEQ ID NO: 463411 - DNA, 508 bp, Homo sapiens
  misc_feature: HEFZJCU01BZR1S.13.79.H02.1.454.heavy.3.raw
tcacgtactacacgaccggtgctcgatttagtgtcacacgaagggaaagggggtctcagagaggagccttaggccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttagtagctattggatgagctgggtccgccaggctccagggaagggctggagtgggtggccaacataaagcaagttggaagtgagaaatactatgtggactctgtgaagggccgattcaccatctccagagacaacgccaagactcactgtatctgcaaatgaacagcctgagagccgaggacacggctgtctattactgtgcgagagagttggggggacggaagggttataggca

SEQ ID NO: 463412 - DNA, 518 bp, Homo sapiens
  misc_feature: HEFZJCU01CQP70.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgagggccgattcatcatctccagagacaacgccgacaactcactgtctctgctgatgagcagcctgagagccgacgacacggctatctattactgtgcgaaactctcattcccgttcactctgaatacgtgggggccaggggaacccctggtccgtcccg

SEQ ID NO: 463413 - DNA, 498 bp, Homo sapiens
  misc_feature: HEFZJCU01DY22J.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaagggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctgggg

SEQ ID NO: 463414 - DNA, 522 bp, Homo sapiens
  misc_feature: HEFZJCU01B1656.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgacccgtgaagggccgattaaccatctccagagacgattccgagaacacggtgtatcttcaaatgaacaacctgagagccgacgacacggccgtttattactgtgcgagagattcgagtggttcggggacctcaccctggttctacttcgtatctctggggcc

SEQ ID NO: 463415 - DNA, 495 bp, Homo sapiens; identical to SEQ ID NO: 452240
  misc_feature: HEFZJCU01CBZBD.4.19.B08.1.454.heavy.3.raw

SEQ ID NO: 463416 - DNA, 510 bp, Homo sapiens
  misc_feature: HEFZJCU01APNEO.15.1.A01.1.454.heavy.3.raw
tctacgtagccacgaccggtgctcgatttagacgtctcatcagggtcttcgtggctcacgtccaccaccacgcatgtgacctcaggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgtgaagggcagattcaccatctccagagacaatttggagaacaccgtgattcttaatatgaacagcctgagagccgatgacacggctgtgtatttctgtgcgagagacgggtataatagttaactggtttggccactggggccagggaaccctggtcatcgtctcgtcagcctccaccaagggcccatcggtcttcccctggcaccctcctccaagagcacctctgggggcacagcggccctgggctcgccgtggtcaaggactactcgctacgt

SEQ ID NO: 463417 - DNA, 509 bp, Homo sapiens; identical to SEQ ID NO: 447939
  misc_feature: HEFZJCU01DN893.17.25.C03.1.454.heavy.3.raw

SEQ ID NO: 463418 - DNA, 525 bp, Homo sapiens
  misc_feature: HEFZJCU01CN9ZX.18.59.F04.1.454.heavy.3.raw
tacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacatcccctgaaagcgtcaactactactactacggtatggacctc

SEQ ID NO: 463419 - DNA, 508 bp, Homo sapiens
  misc_feature: HEFZJCU01C9QTP.3.55.E11.1.454.heavy.3.raw
agacgcactccacgaccggtgctcgatttagcactcgcacgttgggtttgggattcacgttgcagatgtaggtccctgagactctcctgtgcagcctctggattcaccttcagtagatatgctatgtattgggtccgtcaggctccaggcaaggggctggagtgggtggcagttatgtcacatgatggaagaaaaaaatattacgcagactccctgaagggtcgattcaccatctccagagacaattccaacaacaccctgtatttgcaaatgaacagcctgagaactgaagacacggctatctattactgtgcgagagatcagtccggacgacgaaatgactacggtggtaaccttccagactactggggccagggaaccctggtcaccgtctcctcagcctccaccaagggcccatcggtcttcccctggcaccctcctccaagagcacctctgggggcacagcggccctgggctgcctggtcaaggactacttccgagtgcgtct

SEQ ID NO: 463420 - DNA, 396 bp, Homo sapiens
  misc_feature: HEFZJCU01AZB38.16.68.G02.1.454.heavy.3.raw
tgtactactccacgaccggtgctcgatttagtcgatagtgaagggaagggactggagtggattgcctatatctcttacagtgggagcagcaactacaacccctccctcaagagtcgagtcgacatattagtagacacgtccaagaaccagttttccctgaggctgaggtctgtgaccgctgcggacacggccctttattactgtgcgcgagggcccctatcgagtgactatgatcccaggccctttgactccctggggccagggaaccctggtcaccgtctcctcagcctccaccaagggcccatcggtcttccccctggcgccctgctccaggagcacctccgagagcacagcggccctgggctgcctggtcaaggactacttccgagtagtaca

SEQ ID NO: 463421 - DNA, 527 bp, Homo sapiens
  misc_feature: HEFZJCU01DCCDL.48.53.E09.1.454.heavy.3.raw
agtatacatacacgaccggtgctcgatttagagagagtgtgttgggtttgggggtctgagagaggagcccagccctgggattttcaggtgttttcatttggtgatcaggactgaacagagagaactcaccatggagtttgggctgagcgtggtcgttttctaggtgactatttttaaaggtgtccagtgtgaggtgcaactattggagtctgggggtggcctggtgcagccgggggggtccctgagactctcttgtgcagcctctggattcagctttagtaattatgccatgagctgggtccgccaggctccagggaaggggctggagtggatttcatctattagtggtagtggtgttaccacatactacgcagactccgtgaagggccgattcatcatctccagagacagtttccaggaaccacactggatttgcaaatgaacagcctgagagccgaggacacggccctatattactgtgcgaaatcccatgatagtagttggttttttctttttcgtttctttga

SEQ ID NO: 463422 - DNA, 506 bp, Homo sapiens
  misc_feature: HEFZJCU01CLVPF.14.21.B10.1.454.heavy.3.raw
cgtctagtaccacgaccggtgctcgatttagtgtcgtcgcaggagagaggagcccagccctgggattttcaggtgttttcattcggtgatcaggactgaacagagagaactcaccatggagtttgggctgagctggctttttcttgtggctattttaaaaggtgtgcagtgtgaggtgcagctgttggagtctgggggaggcttggtacagcctggggggtccctgagactctcctgtgcagcctctggattcgtctttagcagctatgccatgagctgggctcgccaggctccagggaagggctggagtgggtctctgctattcctggcagtggtgatatcgaatactacgcagactccgtgaagggccggttcactgtttccagagacaattccaagaacacactgtatctgcagatgaccagcctgagagccgaggacacggccgtatattactgtgcgaaacgccaagtatttttggagttggttattatacctttgacttc

SEQ ID NO: 463423 - DNA, 517 bp, Homo sapiens
  misc_feature: HEFZJCU01DZKBN.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggccacgaacgttacacgctatggacgtctggggccaagggaccg

SEQ ID NO: 463424 - DNA, 513 bp, Homo sapiens
  misc_feature: HEFZJCU01BQHCU.47.45.E01.1.454.heavy.3.raw
agctcacgtacacgaccggtgctcgatttagtgagtcagtaagggaaaggggctctcagagaggtgccttagccctggattccaaggcatttccacttggtggggatcaacactgaacacagaggactcaccatggagttggggctgtgctgggttttccttgttgctattttagaaggtgtccagtgtgaggtgcaactggtggagtctgggggaggcttggtacagcctggtgggtccctgagactctcctgtgtagcctctggattcaccttcagttattatagtatgaactgggtccgccaggctccagggaaggggctggagtgggtttcatacattagtagtgacactagtgttagtcctggtagtacaatttactacgcagactctgtgaagggccgattcaccatctccagagacgatgccaggacctcactgtatctgcaaatgaacagcctgagagacgaaagacacggctgtgtattactgtgcgagagaacgtggatacta

SEQ ID NO: 463425 - DNA, 490 bp, Homo sapiens
  misc_feature: HEFZJCU01DP4VI.51.6.A06.1.454.heavy.3.raw
cgatcgtatacacgaccggtgctcgatttagatctactgacagggggctgagctgggttttcctcgttgctcttttaagtaggtgtccagtgtcaggtgcagctggtgcagtctgggggaggcgtggtccagcctgggaggtccctgagactctcctgtgaagcctctggattcagcttcagtacgtatggtttgcgctgggtccgccaggctccaggcaagggactgcagtgggtggcatctatatcatatgaaggaagcaataaatactacgcagactccgtgaagggccgattcaccatctccagagacaatcccaagaacacactttatctgcaaatgaacaccctgagacttgaggacacggctgtctattattgttgcgagagggagatcgatcacagcagccctcgaacgaccagcatgatggttttgatgtctggggccgaaggacaatgtcaccgtctcttcagcctccacccaacggccc

SEQ ID NO: 463426 - DNA, 508 bp, Homo sapiens; identical to SEQ ID NO: 446002
  misc_feature: HEFZJCU01DIT6U.9.78.H01.1.454.heavy.3.raw

SEQ ID NO: 463427 - DNA, 511 bp, Homo sapiens
  misc_feature: HEFZJCU01BU3CF.51.51.E07.1.454.heavy.3.raw
cgatcgtatacacgaccggtgctcgatttagcatactctacaacacacaaaggggctgggagaggagcccagcactagaagtcggcggtgtttccattcgctgatcagcactgaacacagaggactcaccatggagtttgggctgagctgggttttcctcgttgctcttttaagaggtgtccagtgtcaggtgcagatggtggagtctgggggaggcgtggtccagcctgggaggtccctgagactctcctgtgtagcctctggattcaccttcagggtctatgacatgcactgggtccgccaggctccaggcaaggggctggagtgggtggcatttgtatcaaatgatggaaataagaaatactatatagactccgtgaggggccgattcgccatctccagagacaattccaagaacacactgtatctgcacatgaacagcctgagagccgaaagacacgggtgtttactactgtgcgaacttaattacggaggacaacggtaacccccg

SEQ ID NO: 463428 - DNA, 518 bp, Homo sapiens
  misc_feature: HEFZJCU01ET274.40.38.D05.1.454.heavy.3.raw
tctagcgactcacgaccggtgctcgatttagtatctgatagttgggtttggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagttgttggaatctgggggaggcttggtacagcctggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcaggaagtggggagctggtaggcctcaatacg

SEQ ID NO: 463429 - DNA, 385 bp, Homo sapiens
  misc_feature: HEFZJCU01B94Y6.14.57.F02.1.454.heavy.3.raw
cgtctagtaccacgaccggtgctcgatttagctcgatatagttgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaagatacgaagtctatgatacccaatttgggaggggcctttcatgtctggggccaagggacgctggtcaccgtctcttcagcctccaccaagggcccatcggtcttccccctggcaccctcctccaagagcacctctgggggcacagcggccctgggctgcctggtcaaggactacttccgtactagacg

SEQ ID NO: 463430 - DNA, 550 bp, Homo sapiens
  misc_feature: HEFZJCU01EITVB.49.10.A10.1.454.heavy.3.raw
agtcgagagacacgaccggtgctcgatttagcgtcgatctcaggggagctctgggagacgagcccagcactggaagtcgccggtgtttccattcggtgatcatcactgaacacagaggactcaccatggagtttgggctgagctgggttttcctcgctgctcttttaagagacgtccactgttttgtgggcctggtggagtctggggggggctggtccagcccgggaggtccctcagactctcctgtacagacccgacatcttacgtcaggattaataatgtacactggatccgccaggccccaggcaaggggctggagtgggtggcattggtgactcatgtggaagacagaaaattgtacgcagactccgtgaggggccgattcatcatctccaaagactactccaagaatacggtgtatcttcaaatgaatggcctcgttttgcggacacggctgtttattattgtgcgacagggggcccccttcctacggtagacggatcgtatacctactttcgtacctaactacggggtccgacggggtaacccc

SEQ ID NO: 463431 - DNA, 491 bp, Homo sapiens; identical to SEQ ID NO: 449476
  misc_feature: HEFZJCU01DL5A9.3.34.D01.1.454.heavy.3.raw

SEQ ID NO: 463432 - DNA, 511 bp, Homo sapiens
  misc_feature: HEFZJCU01BPGXY.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaaccggcagttagtcacccatactactttgactactggggccg

SEQ ID NO: 463433 - DNA, 536 bp, Homo sapiens
  misc_feature: HEFZJCU01C1L10.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggctttcatgtctggggcaagggacgctggtcaccgtctcttcagcctccaccaagggcccatcggtcttcccctcggcaccctcctccaagagcacctctgggggcacagcc

SEQ ID NO: 463434 - DNA, 392 bp, Homo sapiens
  misc_feature: HEFZJCU01CSPJL.16.70.G04.1.454.heavy.3.raw
tgtactactccacgaccggtgctcgatttagtgtagtgtgaagggaaggggctggagtggatcgggaatatctattatagtgggagcacctactacaacccgtcccccaagagtcgagtcgccatatccgtagacacgtccaagaaccacttctccctgaaactgagctctgtgaccgccgcagacacggctgtctattactgtgcgagacagagttacgacggtggttactccggtctctttgacaactggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 463435 - DNA, 505 bp, Homo sapiens
  misc_feature: HEFZJCU01EMRZP.48.44.D11.1.454.heavy.3.raw
agtatacatacacgaccggtgctcgatttagcgcagtacgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctgcgccctgctccaggagcacctccgagagcacagcggccctgggctgcctggtcaaggactacttcctatgtatact

SEQ ID NO: 463436 - DNA, 520 bp, Homo sapiens
  misc_feature: HEFZJCU01B06AM.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaagggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggcccgtctattattgtgtcatagacctaggatacaacgacggtggtacctggtattcgg

SEQ ID NO: 463437 - DNA, 502 bp, Homo sapiens
  misc_feature: HEFZJCU01CI84J.51.86.H09.1.454.heavy.3.raw
cgatcgtatacacgaccggtgctcgatttagtgctatagacttgggtttgggggggagacgagcccagcactggaagtcgccggtgtttccattcggtgatcatcaccgaacacagaggactcaccatggagtttggactgagctgggttttcctcgttgctcttttaagaggtgtccagtgtcaggtgcagctggtggactctgggggaggcgtggtccagcctgggaggtccctgagactctcctgtgcagcctctggattcaccttcaatacttatggcatgcactgggtccgccaggctccaggcaaggggctggagtggctgtcctttatctcatatgatggaggcaataaaaattatgcagactccgtgaagggccgattcaccatctccagagacaattccaagaacactctatatttgcagatgaatagcctgagaattgaggacacggctgtgtattactgtgtgagagggtcggcatatttcggtttttggt

SEQ ID NO: 463438 - DNA, 483 bp, Homo sapiens
  misc_feature: HEFZJCU01DYB6D.47.59.F04.1.454.heavy.3.raw
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggcccatcggtcttcccctggcgccctgctccaggagcacctccgagagcacagcggcccgtgggctgcctggtcaaggactacttcctacgtgagct

SEQ ID NO: 463439 - DNA, 520 bp, Homo sapiens
  misc_feature: HEFZJCU01AX3SB.10.35.D02.1.454.heavy.3.raw
catagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtctgggggaggcttggttaagccggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctc

SEQ ID NO: 463440 - DNA, 492 bp, Homo sapiens
  misc_feature: HEFZJCU01B5UE2.19.1.A01.1.454.heavy.3.raw
tactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactgggtgcgacaagccctggacaagggcttgagtggatgggaggaagcatccctttctttgatactccagactacgcacagaagttccagggcagagtcacgattaccgcggacgaatccacgagcacagtctatatggaattgaccagcctgacatcagaggacacggccgtctatttttgtgcgacagaaagagattccatactcaggcggggcactatggcagc

SEQ ID NO: 463441 - DNA, 517 bp, Homo sapiens
  misc_feature: HEFZJCU01B2E7K.10.87.H10.1.454.heavy.3.raw
catagtagtgcacgaccggtgctcgatttagcagtactgcgttgggtttgggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtctgggggaggcgtggtccagcctggggggtccctgagactctcctgtgcagcctctggattcgacttcgaaatgtctggcatgcactgggtccgccaggctccaacgaaggggctggagtgggtggcagttctttcattttgatgaaaaagggatattatgcgacctccgtgaagggccgattcagcatctccagagacatttccaaggccacggtgtatctgcaaatgaccagcctgagaagtgaggacacggctatgtactattgtgcgaaggaccttccacctgaaactaatatggggggctttgaacactc

SEQ ID NO: 463442 - DNA, 388 bp, Homo sapiens
  misc_feature: HEFZJCU01CNWH0.18.60.F05.1.454.heavy.3.raw
tacgagtatgcacgaccggtgctcgatttagtacgtcatcagggaaaggggcgtggaatatattgggattacctcttacagtgggaccacccattacaacccgtccctcaaaagtcgactcaccatttccgtggacacgtcgaaaacgagttctccctggactttgacctctgtgaccgccgcagacacggctgtttattactgtgcgagacgactacctgactccaatccatactttgactattggggccggggagccctggtcaccgtctcctcagcctccaccaagggcccatcggtcttccccctggcgccctgctccaggagcacctccgagagcacagacggccctgggctgcctggtcaaggactacttcccatactcgta

SEQ ID NO: 463443 - DNA, 382 bp, Homo sapiens
  misc_feature: HEFZJCU01ER7EY.2.86.H09.1.454.heavy.3.raw
acgctcgacacacgaccggtgctcgatttagtgctatagacttggggtttggggatggatcaacgctaagagtggtggcacaaactatgcacagaaatttcagggcagggtcaccatgaccagggacacgtccacagacacagcctacatggagctgaggagactgagatctgacgacacggccgtgtattattggtttcactcgaccagtggttacacaaggtcccgactttgactcctggggccagggaaccctggtcaccgtctcctcagcctccaccaagggcccatcggtcttccccctggcgccctgctccaggagcacctccgagagcacagcggccctgggctgcctggtcaaggactacttcctgtcgagcgt

SEQ ID NO: 463444 - DNA, 517 bp, Homo sapiens
  misc_feature: HEFZJCU01EG4CG.14.71.G05.1.454.heavy.3.raw
cgtctagtaccacgaccggtgctcgatttagtgtcgtcgcaagagagaggagccttagccctggactccaaggcctttccacttggtgatcagcactgagcacagaggactcaccatggaattggggctgagctgggttttccttgttgctattttagaaggtgtccagtgtgaggtgcagctggtggagtctggggggggcttggtccagcctggggggtccctgagactctcctgtgcagcctctggattcactttttagtaggtattggatgggttgggtccgccagactccagagaagggactggagtgggtggccaacataaaggaagatggaagtgaaagatactatgtggactctgtgaagggccgattcaccatctccagagacaacgccaagaactcactgtatctgcagatgaccagcctgagagtcgaggatacggctgtgtattattgtgcgagagatgggggcacggacatttttgtagagggtgtactggggccaggggacgg

SEQ ID NO: 463445 - DNA, 508 bp, Homo sapiens
  misc_feature: HEFZJCU01EA6BD.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaacacagggactgcagtggattggatacatctacttcagtgggaaccccaactacaacccctccctcaggagtccagtcgccatatccctggactcgtccaacaaccagatctccctgacgatgacatctgtgaccgctgcggacacagccgtttatactgtgcgcgatctgggcgactcagtgactatggtatggacgtctgggggccaagggaccacggtcatcgtctcctcagcctccaccaacggccatcggtctcccctggc

SEQ ID NO: 463446 - DNA, 506 bp, Homo sapiens; identical to SEQ ID NO: 446520
  misc_feature: HEFZJCU01DBLRR.10.38.D05.1.454.heavy.3.raw

SEQ ID NO: 463447 - DNA, 427 bp, Homo sapiens
  misc_feature: HEFZJCU01DD4BV.9.34.D01.1.454.heavy.3.raw
tgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcggccctgggctgcctggtcaaggactacttccaaacgtatca

SEQ ID NO: 463448 - DNA, 509 bp, Homo sapiens
  misc_feature: HEFZJCU01A8KRF.49.20.B09.1.454.heavy.3.raw
agtcgagagacacgaccggtgctcgatttagtgtagtgtgaaggggacccaacaaccacatccctcctcagaagcccccagagcacaacgcctcaccatggactggacctggaggatcctctttttggtggcagcagccacaggtgcccactcccaggtccagcttgtgcagtctggggctgagttgaagaagcctggggcctcagtgagggtttcctgcgtggtctccggatacaccttcactagtcatcctatgcattgggtgcgccaggcccccggacaaaggtttgagtggatgggatggatcaccgctggcaatggtgacacaaaatattcagagaagttccagggcagagtctccattaccagggacacagctgcgagtacagggtacatggaactgagtggcctgagatctgaggacacggctgtttattactgtgcgagagggaagtgggatattgtggcagctccaggtgcccagcccgggcccctactttgactacgtc

SEQ ID NO: 463449 - DNA, 556 bp, Homo sapiens
  misc_feature: HEFZJCU01CCOGE.13.36.D03.1.454.heavy.3.raw
tcacgtactacacgaccggtgctcgatttagctgcgtcacgatctctcttgggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtctggaggaggcttggtccagccgggggggtccctgagactctcatgtgcggcctctgggctcaccgtcaacaccaactacatgagctgggtccgccaggctccagggaagaggccggagtgggtctcagttatttatgtcgacggtgccacattctacgcagactccgtgaggggccggttcaccatctccagagacaattccaagaacacggtgtatcttcaaatgaacgacctgagagccgagtgacgcggccgtagtacttacgtgtgaacgagtagactgggggacccaacgggaacccgttaactacgggcctagtgggacggttctcggggtccaagggaccgtacc

SEQ ID NO: 463450 - DNA, 556 bp, Homo sapiens
  misc_feature: HEFZJCU01B431E.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggctttttcttgtggctttttaaaaggtgcccagtgtgaggtgcaactgttggagtctgggggaggcttggtacagccgggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattactgtgcgaaggatcgcccctataatggtggttggagtcggggagttttggttccgttgggggccgaggggaacccctggtccgtacccg

SEQ ID NO: 463451 - DNA, 521 bp, Homo sapiens
  misc_feature: HEFZJCU01BTU9T.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgtcgcgagagagacacacgaacctactggccaatactatgggggcttgttctggggccaggggaccctggtcatcgtctccccagcctccaccaaggcccatcggtcttcccctggcg

SEQ ID NO: 463452 - DNA, 493 bp, Homo sapiens
  misc_feature: HEFZJCU01ER1DG.4.58.F03.1.454.heavy.3.raw
  modified_base (482)..(482): a, c, t, g, unknown or other
agcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaaagccttgagtggatgggatcgatcaactctggcaatggcaacacaaaatattcacagaagttacagggcagagtcaccattaccagggacacatccgcgaacacagcctacatggagctgagcagcctgacatctgaagacacggctgtgtattactgttcgagacggctagtctgggatctagttatagtnactcgtcgttc

SEQ ID NO: 463453 - DNA, 514 bp, Homo sapiens
  misc_feature: HEFZJCU01AR67O.40.37.D04.1.454.heavy.3.raw
tctagcgactcacgaccggtgctcgatttagtagcatactgttgggtttggggagctctgagagaggagcccagccctgggattttcaggtgttttcatttggtgatcaggactgaacagagagaactcaccatggagtttgggctgagctggcttttcttgtggctattttaaaaggtgtccagtgtgaggtgcagttgttggaatctgggggaagcttggtacagcctggggggtccctgagactctcctgtgcagcctctggattcacctttagcaactatgccatgacctgggtcccgccagactccagggacggggctggagtggtttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcaggaagtgggagctgggtacggcctcaa

SEQ ID NO: 463454 - DNA, 372 bp, Homo sapiens; identical to SEQ ID NO: 444513
  misc_feature: HEFZJCU01EUOAF.5.23.C01.1.454.heavy.3.raw

SEQ ID NO: 463455 - DNA, 504 bp, Homo sapiens
  misc_feature: HEFZJCU01DU1IG.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaagggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtcttttgtatgcctttcgatatgtggggtcgaagggacgaatggtcaccggtctt

SEQ ID NO: 463456 - DNA, 301 bp, Homo sapiens
  misc_feature: HEFZJCU01EPK4D.40.84.H07.1.454.heavy.3.raw
tctagcgactcacgaccggtgctcgatttagcagacgtctgtcgcgggaggagcagttcaacagcacgtaccgtgtggtcagcgtcctcaccgtcgtgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaggactacttccagtcgctaga

SEQ ID NO: 463457 - DNA, 521 bp, Homo sapiens
  misc_feature: HEFZJCU01DQD0Z.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctgggccagggaacccaggtcaccgtctcctcagcctccaccaagggcccatccgtcttccccctggcgccctgctccaggagcacctcccgagagcacagcggccctgggctgcctggtcaggactacttcctacg

SEQ ID NO: 463458 - DNA, 490 bp, Homo sapiens
  misc_feature: HEFZJCU01BZLL7.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgccctgctccaggagcacctccgagagcacagccggccctgggctgcctggtcaaggactacttcccatactcgta

SEQ ID NO: 463459 - DNA, 508 bp, Homo sapiens
  misc_feature: HEFZJCU01CSNZG.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaacacagggactgcagtggattggatacatctacttcagtgggaaccccaactacaacccctccctcaggagtccagtcgccatatccctggactcgtccaacaaccagatctccctgacgatgacatctgtgaccgctgcggacacagccgtttattactgtgcgcgatctgggcgactcagtgactatggtatggacgtctggggccaagggaccacggtcatcgtctcctcagcctccaccaaggcccatcgtcttcccctggc

SEQ ID NO: 463460 - DNA, 502 bp, Homo sapiens; identical to SEQ ID NO: 450016
  misc_feature: HEFZJCU01BW3WO.17.10.A10.1.454.heavy.3.raw

SEQ ID NO: 463461 - DNA, 505 bp, Homo sapiens
  misc_feature: HEFZJCU01DZ58M.51.65.F10.1.454.heavy.3.raw
cgatcgtatacacgaccggtgctcgatttagctacgctctaagggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggattaattccaaaagtggtggcacaaagactgcacagaagtttcagggcagggtcaccatgaccagggacaagtccaccaacacagcctacatggaactaagggactgacatctgacgacacggccatgtattattgtgcgagagaaatgttaggtactgctttgggtccctggggcccgggaaccgggtc

SEQ ID NO: 463462 - DNA, 400 bp, Homo sapiens; identical to SEQ ID NO: 444452
  misc_feature: HEFZJCU01DGHG5.47.24.C02.1.454.heavy.3.raw

SEQ ID NO: 463463 - DNA, 311 bp, Homo sapiens
  misc_feature: HEFZJCU01DPY28.18.53.E09.1.454.heavy.3.raw
tacgagtatgcacgaccggtgctcgatttagagagagtgtgttgggttgggtgcccaagctgctggagggcacggtcaccacgctgctgagcagcctgagatctgaggacacggccgtgtattactgtgctagagagggacgtatagtgggagctcccttttgacttctggggccagggaaccctggtcaccgtctcctcagcttccaccaagggcccatcggtcttccccctggcgccctgctccaggagcacctctgggggcacagcggccctgggctgcctggtcaaggactacttcccatactcgta

SEQ ID NO: 463464 - DNA, 501 bp, Homo sapiens; identical to SEQ ID NO: 447719
  misc_feature: HEFZJCU01CMUGC.17.10.A10.1.454.heavy.3.raw

SEQ ID NO: 463465 - DNA, 432 bp, Homo sapiens; identical to SEQ ID NO: 444920
  misc_feature: HEFZJCU01AF02E.11.39.D06.1.454.heavy.3.raw

SEQ ID NO: 463466 - DNA, 500 bp, Homo sapiens
  misc_feature: HEFZJCU01ER3JS.4.57.F02.1.454.heavy.3.raw
agcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgagacacggctgtctattatgtgcgagagtaagtggtcagtgtccttt

SEQ ID NO: 463467 - DNA, 525 bp, Homo sapiens
  misc_feature: HEFZJCU01DX8OS.12.58.F03.1.454.heavy.3.raw
atacgacgtacacgaccggtgctcgatttagtctgatcgagaagggaaaggggcagagaggagccttagccctggactccaaggcctttccacttggtgatcagcactgagcacagaggactcaccatggaattggggctgagctgggttttccttgttgctattttagaaggtgtccagtgtgagggacaattggtggagtctgggggaggcttggtccagccgggggggtccctgagactctcctgtacagcctctggattcactctcggaaacttttggatggtctgggtccgccaggctccagggaaggggctggagtgggtggccaatatacagtcaggtggaggtacgatacactatctcgactctgtgaagggccggttcaccatctccagagacaacgccaagaattcactgtatctgcaaatgaacagcctgagagtcgaagacacgggtatttattattgtgtgcgagatctggatttccttcgaaatgaagtgtggttcgatgtgtttgattcg

SEQ ID NO: 463468 - DNA, 522 bp, Homo sapiens
  misc_feature: HEFZJCU01CCLSC.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtcttcccctggcgccctgctccaggagcacctccgagagcacagccggccct

SEQ ID NO: 463469 - DNA, 399 bp, Homo sapiens; identical to SEQ ID NO: 444537
  misc_feature: HEFZJCU01AYFO0.16.29.C07.1.454.heavy.3.raw

SEQ ID NO: 463470 - DNA, 512 bp, Homo sapiens; identical to SEQ ID NO: 447721
  misc_feature: HEFZJCU01AJV6P.17.33.C11.1.454.heavy.3.raw

SEQ ID NO: 463471 - DNA, 509 bp, Homo sapiens
  misc_feature: HEFZJCU01DHKJ5.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccgggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcaccctcctccaagagcacctctgggggcacagcggccctgggcctgcctggtcaggactacttcctacgtcgtat

SEQ ID NO: 463472 - DNA, 513 bp, Homo sapiens
  misc_feature: HEFZJCU01DW7VP.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgttcttcaaatgaacagcctgagagccgatgacacggccgtgtattactgtgcgagagatggggcccacgaacgtactacgctatggacgtctggggaccg

SEQ ID NO: 463473 - DNA, 505 bp, Homo sapiens
  misc_feature: HEFZJCU01C66TY.52.86.H09.1.454.heavy.3.raw
cgcagtacgacacgaccggtgctcgatttagtgctatagacttgggtttggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctctttcagcctccaccaagggcccatcggtcttcccctcggcaccctcctccaagagcacctctgggggcacagcggcctggctgcctgtcaaggactactctac

SEQ ID NO: 463474 - DNA, 470 bp, Homo sapiens; identical to SEQ ID NO: 444866
  misc_feature: HEFZJCU01EPK45.4.36.D03.1.454.heavy.3.raw

SEQ ID NO: 463475 - DNA, 516 bp, Homo sapiens
  misc_feature: HEFZJCU01BYB4J.10.53.E09.1.454.heavy.3.raw
catagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgtttcgtttggttctgactcgtcggggggaataccttcagcactc

SEQ ID NO: 463476 - DNA, 465 bp, Homo sapiens; identical to SEQ ID NO: 444805
  misc_feature: HEFZJCU01CK20W.19.10.A10.1.454.heavy.3.raw

SEQ ID NO: 463477 - DNA, 396 bp, Homo sapiens; identical to SEQ ID NO: 444568
  misc_feature: HEFZJCU01C1LAP.47.46.E02.1.454.heavy.3.raw

SEQ ID NO: 463478 - DNA, 511 bp, Homo sapiens; identical to SEQ ID NO: 447235
  misc_feature: HEFZJCU01EZQLQ.16.21.B10.1.454.heavy.3.raw

SEQ ID NO: 463479 - DNA, 490 bp, Homo sapiens
  misc_feature: HEFZJCU01CPV8C.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttccccctggcgccctgctccaggagcacctccgagagcacagcggccctgggctgcctggtcaaggactacttcctatactcgta

SEQ ID NO: 463480 - DNA, 497 bp, Homo sapiens
  misc_feature: HEFZJCU01A69HP.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacgacgggttgtttattacgtggtaggggaagaaatccta

SEQ ID NO: 463481 - DNA, 498 bp, Homo sapiens; identical to SEQ ID NO: 445952
  misc_feature: HEFZJCU01DFTCW.11.71.G05.1.454.heavy.3.raw

SEQ ID NO: 463482 - DNA, 492 bp, Homo sapiens
  misc_feature: HEFZJCU01EM6WH.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagatagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttccccctggcaccctcctccaagagcacctctgggggcacagcggccctgggctgcctggtcaaggactacttccgagtgcgtct

SEQ ID NO: 463483 - DNA, 519 bp, Homo sapiens; identical to SEQ ID NO: 452709
  misc_feature: HEFZJCU01BJBW7.3.82.H05.1.454.heavy.3.raw

SEQ ID NO: 463484 - DNA, 522 bp, Homo sapiens; identical to SEQ ID NO: 446788
  misc_feature: HEFZJCU01C3AT4.12.40.D07.1.454.heavy.3.raw

SEQ ID NO: 463485 - DNA, 505 bp, Homo sapiens
  misc_feature: HEFZJCU01D0GO5.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccgggtgagcctacggcaggcggcctttgacttctc

SEQ ID NO: 463486 - DNA, 486 bp, Homo sapiens; identical to SEQ ID NO: 444861
  misc_feature: HEFZJCU01CYM07.47.55.E11.1.454.heavy.3.raw

SEQ ID NO: 463487 - DNA, 500 bp, Homo sapiens
  misc_feature: HEFZJCU01C60VV.17.10.A10.1.454.heavy.3.raw
  modified_base (459)..(459): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtcattactgtgcgagaatgttttcngtcatcgtacaatttgataggctctatggactggacttctc

SEQ ID NO: 463488 - DNA, 496 bp, Homo sapiens; identical to SEQ ID NO: 446600
  misc_feature: HEFZJCU01AYY34.4.21.B10.1.454.heavy.3.raw

SEQ ID NO: 463489 - DNA, 542 bp, Homo sapiens
  misc_feature: HEFZJCU01BH9XP.16.39.D06.1.454.heavy.3.raw
tgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccagggaaggggctggaatgggtctcagttattgaaaatgatggtgacacaatctacgccgactccgtgaagggccgattcaccatctccagagacaattccaagaacacggtgaatcttcaaatgaacagcctgagaaccgaggacacggccgtatattattgtataggttatggtggtaattcgggcccctgggccagggaaccgtggtcaccgtctcctcagcctccaccg

SEQ ID NO: 463490 - DNA, 511 bp, Homo sapiens
  misc_feature: HEFZJCU01BZZ9N.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggcaccctcctccaagagcacctctgggggcacagcggccctgggctgcctggtcaaggactattccgagtgcgtct

SEQ ID NO: 463491 - DNA, 504 bp, Homo sapiens
  misc_feature: HEFZJCU01A6O9G.10.38.D05.1.454.heavy.3.raw
  modified_base (215)..(215): a, c, t, g, unknown or other
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacngatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttccccctggcgccctgctccaggagcacctccgagagcacagcggccctgggctgcctggtcaaggactactccactacta

SEQ ID NO: 463492 - DNA, 402 bp, Homo sapiens; identical to SEQ ID NO: 444815
  misc_feature: HEFZJCU01C6K8O.11.70.G04.1.454.heavy.3.raw

SEQ ID NO: 463493 - DNA, 523 bp, Homo sapiens
  misc_feature: HEFZJCU01DDSC2.14.55.E11.1.454.heavy.3.raw
cgtctagtaccacgaccggtgctcgatttagcactcgcacgttgggtttggggggaagaggaagactgacggtccccccaggagttcaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgtattactgtgtcagagatggagggggtgtgatccaggtatgattgtgtactactaccacggtctggacgtctggggccaagggaccacggtcaccgtctcctcagcctccaccaagggcccatcggtctcccctggcaccctcctccaagagcacctctgggggcacagcggccctgggctgcctggtcaaggctacttccg

SEQ ID NO: 463494 - DNA, 508 bp, Homo sapiens; identical to SEQ ID NO: 444619
  misc_feature: HEFZJCU01BRAXP.3.81.H04.1.454.heavy.3.raw

SEQ ID NO: 463495 - DNA, 507 bp, Homo sapiens
  misc_feature: HEFZJCU01CDULM.40.53.E09.1.454.heavy.3.raw
tctagcgactcacgaccggtgctcgatttagagagagtgtgttgggtttggggagcccccagagcacaactccttaccatggactggacctggaggatcctctttttggtggcagcagccacaggtgcccactcccaggtccagcttgtgcagtctggggctgaggtgaagaagcctggggcctcagtgagggtttcctgcaaggcgtctggatattccttcactacctacactctgcattggctgcgccaggcccccggacacagctttgagtggatggggtggctcaacgctggcgatggaaaaacaaatattcagagaagttccagggcagagtcaccattacaagggacacaatcgcgcgcaatgcttacatggagttgaggagcctgagatctgaagacacggctgtgtattactgtgtgagaggcggatattgtcgtggtggtgactgctacagtcaaaatcgtcggtggtggttcgaccctggggccagggaaccctcgt

SEQ ID NO: 463496 - DNA, 498 bp, Homo sapiens
  misc_feature: HEFZJCU01EMOZ4.5.41.D08.1.454.heavy.3.raw
atcagacacgcacgaccggtgctcgatttagtcacgcgagaaagggaaagggggcatcacataacaaccagattcctcctctaaagaagcccctgggagcacagctcatcaccatggactggacctggaggttcctctttgtggtggcagcagctacaggtgtccagtcccaggtgcagctggtgcagtctggggctgccgtgaagaagcctgggtcctcggtgacactctcctgcaaggcgtctggagccaccttcaccaactatgctttcaactggtgcgacgggcccctgggcagggacttgagtggctggggcggatcatccctaccgttgatgtggcaaactatgcacagaagttccagggcagagtcacaattaccgcggacaagtccgcgagcacagcctacatggagctgaacaacctgagatctgaagacacggccgtctattactgtacgacctgcgctacggtgactaccgctctgcttcgggacct

SEQ ID NO: 463497 - DNA, 529 bp, Homo sapiens
  misc_feature: HEFZJCU01DH8WY.52.55.E11.1.454.heavy.3.raw
  modified_base (450)..(450): a, c, t, g, unknown or other
cgcagtacgacacgaccggtgctcgatttagcactcgcacgttgggtttgggacataacaaccagattcctcctctaaagaagcccctgggagcacagctcatcaccatggactggacctggaggttcctctttgtggtggctgcagttacagctgtccagtcccaggtccacctggtgcagtctggggctgaagtaaagaagcctgggtcgtcggtgaaggtctcctgcagggcctctggagccaccttcggcacttatgggatcagctgggtgcgccaggcccctggacaagggcttgagtggatgggaagggtcatccctttctttgatttaacgaactacgcacagaaattccagggcagagtcaccattaccgcggacgaatccacgaccacagcctacatggagctgcgcaacctaagatctgacgacacggccgtgttttacngtgcgagatttacagtctcgcccacaacttctggtggcggcggtgttccacctttactacttttgactcctggggccac

SEQ ID NO: 463498 - DNA, 536 bp, Homo sapiens
  misc_feature: HEFZJCU01EVVHR.16.87.H10.1.454.heavy.3.raw
tgtactactccacgaccggtgctcgatttagcagtactgcgttgggtttgggggagccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaagggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcgaaggctagttcgtaggaaacagtttatgggttggggggagttggggttttttttcgttacgttacgggt

SEQ ID NO: 463499 - DNA, 356 bp, Homo sapiens; identical to SEQ ID NO: 444460
  misc_feature: HEFZJCU01DELJM.47.38.D05.1.454.heavy.3.raw

SEQ ID NO: 463500 - DNA, 508 bp, Homo sapiens
  misc_feature: HEFZJCU01ENKUF.52.37.D04.1.454.heavy.3.raw
cgcagtacgacacgaccggtgctcgatttagtagcatactgttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaaagaactcaatgtatctccaaatgagcagcctgacatcgaggacacggccgtgtattactgtgcgagagtttcttgggatgttgtcgttgcac

SEQ ID NO: 463501 - DNA, 506 bp, Homo sapiens
  misc_feature: HEFZJCU01BAJT3.52.23.C01.1.454.heavy.3.raw
cgcagtacgacacgaccggtgctcgatttagtacacgtgattagggattggggagctctgggagaggagcccagcactagaagtcggcggtgtttccattcgctgatcagcactgaacacagaggactcaccatggagtttgggctgagctgggttttcctcgttgctcttttaagaggtgtccagtgtcaggtgcagatggtggagtctgggggagcgtggtccagcctgggaggtccctgagactctcctgtgtagcctctggattcaccttcagggtctatgacatgcactgggtccgccaggctccaggcaaggggctggagtggggtgacatttatatcaaatgatggaaataagaaatactatatagactccgtgaggggccgattcaccatcctccagagacaattccaagaacacgctgtatctgcacatgaacagcctgagagccgaagacacgggtgtttattactgtgcgaacttattacggaggacaacggtaa

SEQ ID NO: 463502 - DNA, 531 bp, Homo sapiens; identical to SEQ ID NO: 446857
  misc_feature: HEFZJCU01BAW8M.7.78.H01.1.454.heavy.3.raw

SEQ ID NO: 463503 - DNA, 523 bp, Homo sapiens
  misc_feature: HEFZJCU01BPH93.52.20.B09.1.454.heavy.3.raw
cgcagtacgacacgaccggtgctcgatttagtgtagtgtgaaggggggaagaggaagactgacggtccccccaggagtttgggctgagctgggttttcctcgttgctcttttaagaggcgtccagtgttatgtgcagctggtggagtctgggggaggcgtggtccagcctgggaggtccctgagactcgcctgtaaaccgtccggatttaccttcagtaactatgcaatgcactgggtccgccaggctccaggcaaggggctggactgggtggcagctatatcatttgatggaagcaataaatactacgcagactccgtgaagggccgattcaccatttccagagacagctccgataacacggtctatctgcgaatgaacagcctgagacctgaggacacggctctttttactgtgcgccaggaagcagtggctggccacatgatgcttttgatatctggagccaagggacaaatggtcatcgtctcttcggcctccaccaagggcccatcggtcttcccccg

SEQ ID NO: 463504 - DNA, 522 bp, Homo sapiens
  misc_feature: HEFZJCU01EJLC7.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacgaacgttactacgctatggacgtcgtggggccgaagggaccg

SEQ ID NO: 463505 - DNA, 397 bp, Homo sapiens; identical to SEQ ID NO: 453166
  misc_feature: HEFZJCU01EEOY9.48.62.F07.1.454.heavy.3.raw

SEQ ID NO: 463506 - DNA, 536 bp, Homo sapiens
  misc_feature: HEFZJCU01EUQL6.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtggtggggctatttacttcgaccccgtggggccggggaaccctggtcaccgtcctccccaccctccaacccg

SEQ ID NO: 463507 - DNA, 483 bp, Homo sapiens
  misc_feature: HEFZJCU01BRXT4.11.23.C01.1.454.heavy.3.raw
cgagagataccacgaccggtgctcgatttagtacacgtgattagggattgggggcagggtgtacacctgtggttctcggggctgccctttggctttggagatggttttctcgatggggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctggcaccctcctccaagagcacctctgggggcacagcggccctgggctgcctggtcaaggctacttccgtatctctcg

SEQ ID NO: 463508 - DNA, 324 bp, Homo sapiens; identical to SEQ ID NO: 444475
  misc_feature: HEFZJCU01DHP92.18.17.B06.1.454.heavy.3.raw

SEQ ID NO: 463509 - DNA, 523 bp, Homo sapiens; identical to SEQ ID NO: 448275
  misc_feature: HEFZJCU01BZAW9.12.40.D07.1.454.heavy.3.raw

SEQ ID NO: 463510 - DNA, 396 bp, Homo sapiens; identical to SEQ ID NO: 444469
  misc_feature: HEFZJCU01EQK45.47.46.E02.1.454.heavy.3.raw

SEQ ID NO: 463511 - DNA, 507 bp, Homo sapiens
  misc_feature: HEFZJCU01CVVV8.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgtttcatctgaaggagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtacttacg

SEQ ID NO: 463512 - DNA, 511 bp, Homo sapiens
  misc_feature: HEFZJCU01AGIUG.22.86.H09.1.454.heavy.3.raw
  modified_base (423)..(423): a, c, t, g, unknown or other
acatacgcgtcacgaccggtgctcgatttagtgctatagacttgggtttgggctgagcgtgggttttcctcgttaggctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgntctctggggccaagggacactggtcaccgtctcttcagcctccaccaagggcccatccggtcttcccctggcgcctcgctccaggacg

SEQ ID NO: 463513 - DNA, 515 bp, Homo sapiens; identical to SEQ ID NO: 456541
  misc_feature: HEFZJCU01EZU4B.26.12.B01.1.454.heavy.3.raw

SEQ ID NO: 463514 - DNA, 519 bp, Homo sapiens
  misc_feature: HEFZJCU01BSK44.16.35.D02.1.454.heavy.3.raw
tgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcacctgggtgcgccagaagcccggtaaaggcctggagtggatggggaggattgatcccagtgactctcacatcaactacagcccgtccttccaaggccacgtcaccatctcagctgacaagtccatcagtactgccttcctgcagtggcgcagcctggaggcctcggacaccgccatatattactgtgcgagtccggttatcgccgcagatcactactactactacggtctggacgtctggggccaagggaccg

SEQ ID NO: 463515 - DNA, 522 bp, Homo sapiens; identical to SEQ ID NO: 455299
  misc_feature: HEFZJCU01ENZGA.16.86.H09.1.454.heavy.3.raw

SEQ ID NO: 463516 - DNA, 514 bp, Homo sapiens
  misc_feature: HEFZJCU01CDEL0.12.27.C05.1.454.heavy.3.raw
atacgacgtacacgaccggtgctcgatttagacgcgatcgaagggtttggggtctgagagaggagcccagccctgggattttcaggtgttttcatttggtgatcaggactgaacagagagaactcaccatggagtttgggctgagctggctttttcttgtggctattttaaaaggtgtccagtgtgaggtgcaactggtggagtctgggggaggcttggtacagccgggggggtccctgagactctcctgtgcaggctctggattcatctttaacaactatgccatgagctgggtccgccaggctccaggggaaggggctggagtgggtctcagctattagtaatagtggtgatagcacatcctacgcagactccgtgaagggccgcttcaccatctccagagacaattccaagaacacgctgtatctccaaatgaacagtctcagagccgaggacacggccatatattactgtgcgaaagacacagccgcatttgggggatcatcgtccttgg

SEQ ID NO: 463517 - DNA, 512 bp, Homo sapiens; identical to SEQ ID NO: 445688
  misc_feature: HEFZJCU01DDC2J.3.34.D01.1.454.heavy.3.raw

SEQ ID NO: 463518 - DNA, 505 bp, Homo sapiens
  misc_feature: HEFZJCU01ELPK5.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggccttttgacttcgtc

SEQ ID NO: 463519 - DNA, 400 bp, Homo sapiens; identical to SEQ ID NO: 444452
  misc_feature: HEFZJCU01AIULE.47.24.C02.1.454.heavy.3.raw

SEQ ID NO: 463520 - DNA, 491 bp, Homo sapiens; identical to SEQ ID NO: 447981
  misc_feature: HEFZJCU01DE7VU.47.85.H08.1.454.heavy.3.raw

SEQ ID NO: 463521 - DNA, 491 bp, Homo sapiens
  misc_feature: HEFZJCU01B9A91.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttccccctggcgccctgctccaggagcacctccgacgagcacagcggccctgggctgcctggtcaaggactacttcctacgtgagct

SEQ ID NO: 463522 - DNA, 495 bp, Homo sapiens
  misc_feature: HEFZJCU01B62WS.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccaagagcacctctggggcacagcggccctgggctgcctggtcaaggactacttccgagtagtata

SEQ ID NO: 463523 - DNA, 516 bp, Homo sapiens
  misc_feature: HEFZJCU01BBQSD.40.43.D10.1.454.heavy.3.raw
tctagcgactcacgaccggtgctcgatttagactagcagtaagggggctctgagagaggagcccagccctgggattttcaggtgttttcatttggtgatcaggactgaacagagagaactcaccatggagtttgggctgagctggctttttcttgtggctattttaaaaggtgtccagtgtgaggtgcagttgttggagtctgggggaggcttggcacagcctggggggtcccggagactctcctgtgcagcctctggattcgcctttcagaactctgccatgcactgggtccgccagcctccagggaaggggctggagtgggtctcaggtattcggggtgatggtactgacacatactacgcagactctgcgaagggccggttcaccatctccagagacatttccaagaacacactctatctgcaaatgaccaacctcagaggcgaggacacggccatatattactgtgcgaaaggtggtgactatgaccactggggccaggggaaccctggtcc

SEQ ID NO: 463524 - DNA, 484 bp, Homo sapiens
  misc_feature: HEFZJCU01BJMAY.49.33.C11.1.454.heavy.3.raw
  modified_base (472)..(472): a, c, t, g, unknown or other
agtcgagagacacgaccggtgctcgatttagagtgagctcgttgggtttgggggggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctgaagacaggctgtatattactgtgngaacttaatcac

SEQ ID NO: 463525 - DNA, 494 bp, Homo sapiens
  misc_feature: HEFZJCU01A4SL3.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggccggttctccatctccagagacaattccaagaacacgctgtatctgcaattgaacagcctgagagccgaggacacggccgtatattactgtgcgaaagagtttggggaatcgaccactc

SEQ ID NO: 463526 - DNA, 501 bp, Homo sapiens; identical to SEQ ID NO: 447123
  misc_feature: HEFZJCU01EWBLX.3.20.B09.1.454.heavy.3.raw

SEQ ID NO: 463527 - DNA, 508 bp, Homo sapiens
  misc_feature: HEFZJCU01C9QTA.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaagggctggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgcgaaagatctcgggctggttccgcggtccgggta

SEQ ID NO: 463528 - DNA, 504 bp, Homo sapiens
  misc_feature: HEFZJCU01AK0IX.51.78.H01.1.454.heavy.3.raw
cgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggattttccttttggctattttaaaaggtgtccagtgtgaagtgctactggtggagtctgggggaggcctggtacagcctggcaggtccctgagactctcctgtgcagcctctggattcacctttgatgattatgccatgcactggggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgccgcaaaagccaaggcaacagctggta

SEQ ID NO: 463529 - DNA, 527 bp, Homo sapiens
  misc_feature: HEFZJCU01D93QY.53.36.D03.1.454.heavy.3.raw
  modified_base (476)..(476): a, c, t, g, unknown or other
cgcgtatacacacgaccggtgctcgatttagctgcgtcacgatctctcttgggggaggcttggttcagccagggcggtccctgagactctcctgtacaacttcaggattcacctttggtgattatgctatgacctgggtccgccaggctccagggaaggggctggagtgggtaggtttcgttagaagcaaaactgatggtgggacaacagaatacgccgcgtctgtgaaaggcagatttatcatctcaagagatgattccagaggcatcgcctatctgcaaatgaacagcctgaaaaccgaggacacagccgtgtatttctgtactagagtcttcttgtattactatgatactagtggttatacaggagtggggcacggtatggacgtctggggccaagggaccacggtcaccgtctcctcagcctccaccaagggcccatcggtcttcccctggccaccctcctccaagagaccncctctcggggcacgagcggccctgggctgcctggtcaggactacttcctcg

SEQ ID NO: 463530 - DNA, 503 bp, Homo sapiens
  misc_feature: HEFZJCU01CG9IV.15.55.E11.1.454.heavy.3.raw
tctacgtagccacgaccggtgctcgatttagcactcgcacgttgggtttgggggaggcttggtacagcctggggggtccctgagactctcccgtgcagcctcaggattcgcctttcgcatctatgccatgacctgggtccgccaggctccagggaaggggctggagtggatctcagctattagtggaggtggtagtggtgaaaacacatattacgcaggctccgtgaagggccgcttcaccatctccagagacaattccaacaacacactttatcttcaaatgaacagcctgcgagccgaggacacggccgtatactactgtgcgagagatcgaacaggcccgtgggagcccgttgactactggggccagggaaccctggtcaccgtctcctcaacctccaccaagggcccatcggtcttcccctggcaccctcctccaagagcacctctgggggcacagcggccctgggctgcctggtcaaggactacttccgctacgtaga

SEQ ID NO: 463531 - DNA, 522 bp, Homo sapiens
  misc_feature: HEFZJCU01B2OKS.4.59.F04.1.454.heavy.3.raw
agcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtgactccataagtagtttcttctggagctggatccggcagcccccagggaagggactggagtggattggccatatctcttacagtgggagcaccaactacaaccctcctcaagagtcgtgtcaccgtgtcaatagacacgtccaagaaccagttctccctgaggctgagctctgtgaccgccgcggacacggccgtgtatttctgtgcgagatctttcgatttttggagtggtaaccccttggctactgggccagggaacctggtcaccgtctcttcagcctccaccaaggcc

SEQ ID NO: 463532 - DNA, 500 bp, Homo sapiens; identical to SEQ ID NO: 446033
  misc_feature: HEFZJCU01AYZA1.11.27.C05.1.454.heavy.3.raw

SEQ ID NO: 463533 - DNA, 520 bp, Homo sapiens
  misc_feature: HEFZJCU01BMKT1.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccaggacaacgccaagaactcactgactttgcaaatgaacaccctgcgagccgaggacacggccgtatattactgtgcgagaataacccgttcgcctggttatttacc

SEQ ID NO: 463534 - DNA, 494 bp, Homo sapiens
  misc_feature: HEFZJCU01BZHMB.11.71.G05.1.454.heavy.3.raw
cgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagtatttactat

SEQ ID NO: 463535 - DNA, 384 bp, Homo sapiens; identical to SEQ ID NO: 444454
  misc_feature: HEFZJCU01BGMRK.11.61.F06.1.454.heavy.3.raw

SEQ ID NO: 463536 - DNA, 500 bp, Homo sapiens
  misc_feature: HEFZJCU01D3720.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccataatcagtagacacgtccaagagccagttctccctgaagctgagggctgtgagcgccgcagacacggccgtgtattactgtgcgagactggccgcaacagactacggtggcaactcctatgtctttgatatctgggccaagggac

SEQ ID NO: 463537 - DNA, 520 bp, Homo sapiens
  misc_feature: HEFZJCU01DO01A.13.76.G10.1.454.heavy.3.raw
tcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacggtgtatcttcaaatgaacgacctgagagtcgaggacacggccgtctattactgtgcgaaagatgcagagacggggccccgtaagtggggcctggtggagggttcttctttgact

SEQ ID NO: 463538 - DNA, 503 bp, Homo sapiens; identical to SEQ ID NO: 450415
  misc_feature: HEFZJCU01B21A4.15.55.E11.1.454.heavy.3.raw

SEQ ID NO: 463539 - DNA, 402 bp, Homo sapiens; identical to SEQ ID NO: 444815
  misc_feature: HEFZJCU01DY807.11.70.G04.1.454.heavy.3.raw

SEQ ID NO: 463540 - DNA, 514 bp, Homo sapiens
  misc_feature: HEFZJCU01CEW55.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacgaacgttactacgctatggacgtcgtggggccaa

SEQ ID NO: 463541 - DNA, 529 bp, Homo sapiens
  misc_feature: HEFZJCU01D5U2M.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttgggccagggaaccctggtcaccgtctcctcagcctccaccaagggcccatcggtcttccccctggcaccctcctccagagcacctctggggcacagcggccctgggctgcct

SEQ ID NO: 463542 - DNA, 510 bp, Homo sapiens
  misc_feature: HEFZJCU01DEK2N.52.33.C11.1.454.heavy.3.raw
cgcagtacgacacgaccggtgctcgatttagagtgagctcgttgggttggggacccaacaaccacatccctcctcagaagcccccagagcacaacgcctcaccatggactggacctggaggatcctctttttggtggcagcagccacaggtgccgactcccaggtccaacttgtgcagtctggggctgagttgaagaagcctggggcctcagtgaaggtttcctgcatggtttctggatattccctgactagtcatgctatgcattgggtgcgccaggcccccggacaaaggtttgaggtggatgggatggatcaccgctggcaatggtgacacaaaatattcacagaagttccagggcagagtcaccattaacagggacacatcctgcgagtacaggctacatggaactgagcgggcctgagattctgaggacacggctatttattactgtgcgagagggaagtggggatattgtggcagctccaggtgcccaggcccggcccccgtta

SEQ ID NO: 463543 - DNA, 506 bp, Homo sapiens
  misc_feature: HEFZJCU01DAN3Z.51.65.F10.1.454.heavy.3.raw
cgatcgtatacacgaccggtgctcgatttagctacgctctaagggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggattaattccaaaagtggtggcacaaagactgcacagaagtttcagggcagggtcaccatgaccagggacaagtccaccaacacagcctacatggaactaagggactgacatctgacgacacggccatgtattattgtgcgagagaaatgttaggtactgctttgggtccctggggcccggaacccggggtc

SEQ ID NO: 463544 - DNA, 490 bp, Homo sapiens; identical to SEQ ID NO: 454974
  misc_feature: HEFZJCU01AKA4U.19.53.E09.1.454.heavy.3.raw

SEQ ID NO: 463545 - DNA, 338 bp, Homo sapiens
  misc_feature: HEFZJCU01C2S6X.49.70.G04.1.454.heavy.3.raw
agtcgagagacacgaccggtgctcgatttagtgtagtgtgaagggaaagggccgattcatcatctccagagacaactccgagaacacgctgtatctgcaaatgaacaggctgagagctgaagacacggctttatattactgtgcgaacttaatcacggaggacaacggtgaccccgtccgctcggtgcggaggtctggggccaagggaccacggtcatcgtctcctcagcctccaccaagggcccatcggtcttccccctggcaccctcctccaagagcacctctgggggcacagcggccctgggctgcctggtcaaggactacttcctctctcgact

SEQ ID NO: 463546 - DNA, 504 bp, Homo sapiens; identical to SEQ ID NO: 455206
  misc_feature: HEFZJCU01AC0GW.47.81.H04.1.454.heavy.3.raw

SEQ ID NO: 463547 - DNA, 520 bp, Homo sapiens
  misc_feature: HEFZJCU01EL6YJ.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttcccctggcaccctcctccaagagcacctctgggggcacagcggccctgggctgcctggtcaaggactacttccgagtagtactac

SEQ ID NO: 463548 - DNA, 477 bp, Homo sapiens; identical to SEQ ID NO: 444659
  misc_feature: HEFZJCU01B2W92.16.10.A10.1.454.heavy.3.raw

SEQ ID NO: 463549 - DNA, 517 bp, Homo sapiens
  misc_feature: HEFZJCU01BAKNW.10.53.E09.1.454.heavy.3.raw
catagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcgtcgggggaataccttcagcactggggccgac

SEQ ID NO: 463550 - DNA, 409 bp, Homo sapiens
  misc_feature: HEFZJCU01C5NP5.3.41.D08.1.454.heavy.3.raw
agacgcactccacgaccggtgctcgatttagtcacgcgagaaagggaaaggggctggaatgggttgcatacatttcaagtagtggttccaccatacattatgtagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactggggccaggggaccctggtcaccgtctcctcagcttccaccaagggcccatcggtcttccccctggcgccctgctccaggagcacctctgggggcacagcggccctgggctgcctggtcaaggactacttccgagtgcgtct

SEQ ID NO: 463551 - DNA, 467 bp, Homo sapiens; identical to SEQ ID NO: 444941
  misc_feature: HEFZJCU01EZSNK.16.78.H01.1.454.heavy.3.raw

SEQ ID NO: 463552 - DNA, 523 bp, Homo sapiens
  misc_feature: HEFZJCU01B0YZ7.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtcgtggggaccaaggggacccg

SEQ ID NO: 463553 - DNA, 521 bp, Homo sapiens; identical to SEQ ID NO: 445317
  misc_feature: HEFZJCU01BEU58.12.40.D07.1.454.heavy.3.raw

SEQ ID NO: 463554 - DNA, 506 bp, Homo sapiens
  misc_feature: HEFZJCU01ERN4P.22.86.H09.1.454.heavy.3.raw
  modified_base (491)..(491): a, c, t, g, unknown or other
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctgggccaagggacactggtcaccgtctcttcagcctccaccaagggcccatcggtcttcccctggcnccctgctccaggacg

SEQ ID NO: 463555 - DNA, 489 bp, Homo sapiens
  misc_feature: HEFZJCU01CDQUX.51.86.H09.1.454.heavy.3.raw
cgatcgtatacacgaccggtgctcgatttagtgctatagacttggctctgggagacgagcccagcactggaagtcgccggtgtttccattcggtgatcatcaccgaacacagaggactcaccatggagtttggactgagctgggttttcctcgttgctcttttaagaggtgtccagtgtcaggtgcagctggtggactctgggggaggcgtggtccagcctgggaggtccctgagactctcctgtgcagcctctggattcaccttcaatacttatggcatgcactgggtccgccaggctccaggcaaggggctggagtggctgtcctttatctcatatgatggaggcaataaaaattatgcagactccgtgaagggccgattcaccatctccagagacaattccaagaacactctatatttgcagatgaatagcctgagaattgaggacacggctgtgtattactgtgtgagagggtcggcatatttcc

SEQ ID NO: 463556 - DNA, 492 bp, Homo sapiens
  misc_feature: HEFZJCU01EBF86.53.53.E09.1.454.heavy.3.raw
cgcgtatacacacgaccggtgctcgatttagagagagtgtgttgggtttgggggagcatcaccctgcaaccacagctgtcctctagagaacccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcagggcagggtctccatgaccagggacagggccatcagaacagcctacatggagctgaacagactgacatctgacgacacggccgtttattattgtgtgagagaggacccgatgacctc

SEQ ID NO: 463557 - DNA, 554 bp, Homo sapiens
  misc_feature: HEFZJCU01CPMPH.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatctttcaaattgaataacctgagagccgaggacacggccatgtattaactgtgtgggggcagtttacttgtacccccgtgggggccggggggaaaccccgttgggtccgaccggtcctcccccacccctcccaacccg

SEQ ID NO: 463558 - DNA, 501 bp, Homo sapiens
  misc_feature: HEFZJCU01ECLF9.16.34.D01.1.454.heavy.3.raw
tgtactactccacgaccggtgctcgatttagatcgtctgtgttgggtttgggggaggcttggtacagcctggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccggttcaccatctccagagacaattccaagaacacactgtatctgcaaatgaacagcctgagagccgacgacacggccatatattactgtgcgaaagcaccggcagttagtcacccatactacttttgactactggggccagggaaccctggtcatcgtctcctcagcctccaccaagggcccatcggtcttcccctggcaccctcctccaagagcacctctgggggcacagcggccctgggctgcctggtcaaggactacttccgagtagtaca

SEQ ID NO: 463559 - DNA, 509 bp, Homo sapiens
  misc_feature: HEFZJCU01D96LH.14.23.C01.1.454.heavy.3.raw
  modified_base (499)..(499): a, c, t, g, unknown or other
cgtctagtaccacgaccggtgctcgatttagtacacgtgattagggattggggccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcactttcagcacctatgctatcaactgggtgcgacaggcccctggacaagggcttgagtggatgggaggaatcatccctatgtttggtacaactaactacacacagaagttccagggcagagtcacgattaccgcggacgaatccacgagcacagcctacatggagctgagcagcctgagatctgacgacacggccgtgtattactgtgcgagggccttcgggtttctctagtgcctggttgagaacgtggggccgagggaactctggtcaccgtcctcctcgacncctccacccg

SEQ ID NO: 463560 - DNA, 497 bp, Homo sapiens
  misc_feature: HEFZJCU01EAW7R.51.78.H01.1.454.heavy.3.raw
cgatcgtatacacgaccggtgctcgatttagtgtgagtagtttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgctactggtggagtctgggggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaatgaacagtctgagagctgaggacacggccttgtattactgcgcaaagccaaggcaacagct

SEQ ID NO: 463561 - DNA, 518 bp, Homo sapiens
  misc_feature: HEFZJCU01BAJ6H.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaactttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctgggccagggaaccctggtcaccgtctcctcagcctccaccaagggcccatcggtcttcccctggcaccctcctccaagagcacctctgggggcacagcggccctgggatgcctggtcaaggactacttccgagtagtaca

SEQ ID NO: 463562 - DNA, 483 bp, Homo sapiens
  misc_feature: HEFZJCU01B8SFI.19.13.B02.1.454.heavy.3.raw
tactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaaggccgattcaccatctccagagacaattccaagaacacgctgtatctgcaaatgaacagcctgagagctgaggacacggctgtgtattactgtgcgaggcggt

SEQ ID NO: 463563 - DNA, 528 bp, Homo sapiens; identical to SEQ ID NO: 448952
  misc_feature: HEFZJCU01EZNQQ.16.27.C05.1.454.heavy.3.raw

SEQ ID NO: 463564 - DNA, 508 bp, Homo sapiens
  misc_feature: HEFZJCU01CF2VI.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctgggtcatcgtctcctcagcctccaccaagggcccatcggtcttcccctggcaccctcctccaagagcacctctgggggcacgagcggccctgggctgcctggtcaaggactacttccgagtagtaca

SEQ ID NO: 463565 - DNA, 510 bp, Homo sapiens
  misc_feature: HEFZJCU01CRFT2.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccataccttactttgactacgtgggg

SEQ ID NO: 463566 - DNA, 470 bp, Homo sapiens
  misc_feature: HEFZJCU01EFGM0.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggccatcggtcttcccctggccgccctgctccaggagcacctccgagagcacagcggccctgggctgcctggtcaaggactacttccctacagtgct

SEQ ID NO: 463567 - DNA, 502 bp, Homo sapiens
  misc_feature: HEFZJCU01B1SH1.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagcctgggggaggcgtggtccagcctgggaggtccctgagactctcctgtacagcctctggcttcaccttcattacctatggcatgcactgggtccgccagactccaggcagggggctggagtggggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagatttctataggaggtgacgtacggggggcgttcg

SEQ ID NO: 463568 - DNA, 528 bp, Homo sapiens
  misc_feature: HEFZJCU01CN5WS.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcacgcctccacc

SEQ ID NO: 463569 - DNA, 509 bp, Homo sapiens; identical to SEQ ID NO: 458005
  misc_feature: HEFZJCU01AQI2G.51.81.H04.1.454.heavy.3.raw

SEQ ID NO: 463570 - DNA, 503 bp, Homo sapiens
  misc_feature: HEFZJCU01EWPNP.52.67.G01.1.454.heavy.3.raw
cgcagtacgacacgaccggtgctcgatttagagtatacatattgggtttgggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccggacaagggcttgtttggatgggatggatcaacgctggcaatggtaacacaaaatattcacagaagttccagggcagagtcaccatcaccagggacacatccgcgagcacagcctacatggagttgagcagcctgagaaatgaagacacggctgtatattactgtgcgagaggggaaatgggtaaggatttttggagtaattattatcctggcggtgcgg

SEQ ID NO: 463571 - DNA, 468 bp, Homo sapiens
  misc_feature: HEFZJCU01BNABM.48.7.A07.1.454.heavy.3.raw
agtatacatacacgaccggtgctcgatttagcacgtgtcgcaggggcagggtgtacacctgtggttctcggggctgtcctttggttttggagatggttttctcgatgggggctgggatggctcaacgctgacgatggtcaaacaaaatattcacagcaattccagggcagactctcccttaccagggacacttccgcgaacacaggctacatgtttttgagcagactgacatctaaagacacggctatttactactgtgcgagaggcggattttgtcggcgtggtgattgttacagtcagaatcgtcgattgtggttcgacccctggggccagggaaccctgctctccgtctcctcagcttccaccaagggcccatcggtcttccccctggcgccctgctccaggagcacctctgggggcacagcggccctgggctgccgtggtcaaggactacttcctatgtatact

SEQ ID NO: 463572 - DNA, 487 bp, Homo sapiens
  misc_feature: HEFZJCU01AX6CX.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctggtcagctactccgtatctctcg

SEQ ID NO: 463573 - DNA, 511 bp, Homo sapiens
  misc_feature: HEFZJCU01BUR0O.49.27.C05.1.454.heavy.3.raw
agtcgagagacacgaccggtgctcgatttagacgcgatcgaagggtttggggctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccggggaagggtctggagtgggtctctcttattaattgggatggtggtatcacctactatgcagactctgtgaagggtcgattcaccatctccagagacaacagcagaaactccctgtatctgcaaatgaacagtctcagaggtgaggacaccgccttctactactgtgacaaagattacggtgaccacacctattttgaccactgcc

SEQ ID NO: 463574 - DNA, 519 bp, Homo sapiens
  misc_feature: HEFZJCU01A3QDS.52.78.H01.1.454.heavy.3.raw
cgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggccgtggcaccctggtcactgtcttctcagcctccaccaagggcccatcggtcttccccctggcaccctcctccaagagcacctctgggggcacagcggccctgggctgcctggtcaaggactacttcctatacga

SEQ ID NO: 463575 - DNA, 304 bp, Homo sapiens
  misc_feature: HEFZJCU01APTAP.49.82.H05.1.454.heavy.3.raw
agtcgagagacacgaccggtgctcgatttagtcgagctctctcgcgggcacgaccggtgctcgatttagtatctgatagttgggttttggggggaagaggaagactgacggtcctcccaggagttcaggtgctgggcaccgtgggcatgggggaggtgtgtcacaagatttgagccctggtcaccgtctcctcagcttccaccaagggcccatcggtcttccccctggcgccctgctccaggagcacctctgggggcacagcggccctgggctgcctggtcaaggactacttcctctctcgact

SEQ ID NO: 463576 - DNA, 508 bp, Homo sapiens
  misc_feature: HEFZJCU01BR14E.4.67.G01.1.454.heavy.3.raw
  modified_base (423)..(423): a, c, t, g, unknown or other
agcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggcttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtntatctgcaaatgaacagcctgagagccgaggacacggccacatattactgtgcgaaagatctcgggctggttccgcggtccgggt

SEQ ID NO: 463577 - DNA, 490 bp, Homo sapiens
  misc_feature: HEFZJCU01E1JO3.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtggagtccctggctggcacctgtatccgaccgttggagtcagggaactctggtcaccgtctcctcagcctccaccaagggcccatcggtcttccccctggcgccctgctccaggagcacctccgagagcacagcggccctgggctgcctggtcaggactacttccgtatctctcg

SEQ ID NO: 463578 - DNA, 507 bp, Homo sapiens
  misc_feature: HEFZJCU01C7IDM.12.30.C08.1.454.heavy.3.raw
atacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtggctccatcagcagtggtgattattactggagttggatccgccagtccccagggaagggcctggagtggattgggtacatctatcacagtgggagcacctactacatcccgtccctgaagagtcgaattacgatgtcagtaaacacgtctaggaaccagttctccctgaagctgaggtctgtgactgccgcagacacggccgtctactactgtgccaggtgggctttgcgccagtggttcagagatgatcgcttcgattcgtggggccagggaattcg

SEQ ID NO: 463579 - DNA, 497 bp, Homo sapiens
  misc_feature: HEFZJCU01ET4AT.13.39.D06.1.454.heavy.3.raw
tcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctggggccaagggaccacggtcaccgtctcctcagcctccacc

SEQ ID NO: 463580 - DNA, 531 bp, Homo sapiens
  misc_feature: HEFZJCU01A9N24.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgagtccgtcattgtcgcggacacagccgtctattattgtgtcagagatccggcccataactggctcggcccctgggggcccgggaaccctggtcaccgtctcctcagcctccaccaagggcccatcggtcttcccctggctaccctcctcc

SEQ ID NO: 463581 - DNA, 506 bp, Homo sapiens
  misc_feature: HEFZJCU01ARJIB.49.23.C01.1.454.heavy.3.raw
agtcgagagacacgaccggtgctcgatttagtacacgtgattagggattggggagcatcacataacaaccagattcctcctctaaagaagcccctgggagcacagctcatcaccatggactggacctggaggttcctctttgtggtggcagcagctacaggtgtccagtcccaggtccagctggtgcaatctggggctgaggtgaagaagcctgggtcctcggtgaaggtctcctgtaaggcttctggaggcaccctcagcagttatactatgaattgggtgcgacaggcccctggacaagggcttgagtggatggggaggatcatccctattgttggtgtgacaaactacgcacagaagttccaggacagaatcacgataaccgcggacacatccacgagcactattttcatggaactgagcagcctcagatccgaggacacggccgtttactactgtgcgagcgatcccggattcccgcgtttcgaggatgactactgggccac

SEQ ID NO: 463582 - DNA, 531 bp, Homo sapiens
  misc_feature: HEFZJCU01EON9G.16.27.C05.1.454.heavy.3.raw
  modified_base (444)..(444): a, c, t, g, unknown or other
  modified_base (491)..(491): a, c, t, g, unknown or other
  modified_base (513)..(513): a, c, t, g, unknown or other
  modified_base (521)..(521): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagtaggtgtccagagtcaggtgcagctggtggagtctgggggaggcgttgtccagcctgggaggtcgttgagactctcctgtgaaggctctggattcacattcagtgactatggcatacactgggtccgaccaggctacaggcaaggggctgaagtgggtggcgtttatttcatatgatggaactactcaacactatccagactccggggagggccgattcaccgtctccagagacaattccaagaacagggtgtttctccaagtgattgatctganaagtgaggacacggcttgtttattactgtgcgcggtgctgaccgctnttgactacgtgggggccggganccccggtnatcgtcctcc

SEQ ID NO: 463583 - DNA, 519 bp, Homo sapiens
  misc_feature: HEFZJCU01B7VNX.53.17.B06.1.454.heavy.3.raw
cgcgtatacacacgaccggtgctcgatttagtcgatagtgaagggggctctgggagaggagcccagcactagaagtcggcggtttttccattcggtgatcagcactgaacacagaggactcaccatggactgttaagaggtgtgtcgagcactgggtccgccaggctccaggcaaggggctgaagtgactgccacttaacatcagatgatcgaatcaataggttttatgcggactcggtgaggggccgattcaccgtctccggagacaattccaagaatacgagataggtgcaaatgaagaccctgggacttgaagacacgggtgcgtcttcctgtgcgactgtgtcccaacgttgtattctttgagtggacgtctcgagaacaagggaccacggtcatcgtctcctccgatgagactgaccactctggggcctttgatttccgccactgcctgtggaatttccgcactagtggagcctccaccaagggcccatcggtcttcccctggcaccctcctcc

SEQ ID NO: 463584 - DNA, 475 bp, Homo sapiens
  misc_feature: HEFZJCU01EO05B.3.39.D06.1.454.heavy.3.raw
agacgcactccacgaccggtgctcgatttagtgacatctcgcagttctttgggttttggggggtccctgagactctcatgtacaggctctgagttcagcgtcactaaatactacatgagctgggtccgccaggctccagggaggggactggactgggtctccagtgttaacagcgatggaagtacatattatgcagactccgtgaagggccgattcaccatctccagagacaattccaagaacactctgtatcttcaaatgaacagcctgagagccgaggacacggccttctattactgtgcgagcgatcacgggcggagtctgatactttcttggggccagggaaccctggtcaccgtctcctcagcctccaccaagggcccatcggtcttcccctggcgccctgctccaggagcacctccgagagcacagcggcccgtgggctgcctggtcaaggactactccgagtgcgtct

SEQ ID NO: 463585 - DNA, 471 bp, Homo sapiens
  misc_feature: HEFZJCU01DOXWN.15.16.B05.1.454.heavy.3.raw
tctacgtagccacgaccggtgctcgatttagagctcacgtattgggtctgggggaggcctcgtccagccgggggggtccctgagactctcctgtgaagcctctggattcaccttgagcacttattggatgacttgggtccgccaggctccagggaaggggctggagtgggtggccaccatacaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttggggccagggaaccctggtcaccgtctcctcagcctccaccaagggccatcggtctcccctgcgcctgctccaggagcacctccgagagcacagcggccctgggctgcctggtcaaggactacttccgctacgtaga

SEQ ID NO: 463586 - DNA, 513 bp, Homo sapiens
  misc_feature: HEFZJCU01DJ27K.16.21.B10.1.454.heavy.3.raw
tgtactactccacgaccggtgctcgatttagtgtcgtcgcaggagagaggagcccagcccagggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatacctactttgactacgtggggaccg

SEQ ID NO: 463587 - DNA, 532 bp, Homo sapiens
  misc_feature: HEFZJCU01A80M5.12.71.G05.1.454.heavy.3.raw
atacgacgtacacgaccggtgctcgatttagtgtcgtcgcaagagagagggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccaggtcaccgtctcctcagcctccaccaagggcccatcccgtcttccccctcggccgccctgcctccaggagcaccctcccgacgaggcacacgcggccctggggctgcctggtcaaggactacttcctaccg

SEQ ID NO: 463588 - DNA, 506 bp, Homo sapiens
  misc_feature: HEFZJCU01DIV39.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaaagtgacgtggtatccggggggacgacatgacaccg

SEQ ID NO: 463589 - DNA, 501 bp, Homo sapiens
  misc_feature: HEFZJCU01CPCAQ.15.20.B09.1.454.heavy.3.raw
tctacgtagccacgaccggtgctcgatttagtgtagtgtgaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacagagtatgcagagaagttccagggcagagtcatcatcaccgcggacacatccacgagtacagcctacatggaactgaggagcctcagatctgacgacacggccacttattactgcgcgagagattattgcactggtcctggctgtaaccacgcttgtgggcactgggccac

SEQ ID NO: 463590 - DNA, 500 bp, Homo sapiens
  misc_feature: HEFZJCU01AT46G.12.2.A02.1.454.heavy.3.raw
atacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgagtggatgggatggatcagcgcttacaatggtaacacagactatgcacagaagttccaggacagagtcaccatgaccacagacacatccacgagcacagcctacatggagctgaggagcctgagatctgacgacacggccgtgtattactgtgcgagaggttttagtgtatacttattgtagtgggttggtacctgctacgtttttc

SEQ ID NO: 463591 - DNA, 492 bp, Homo sapiens; identical to SEQ ID NO: 445919
  misc_feature: HEFZJCU01BVI5C.14.25.C03.1.454.heavy.3.raw

SEQ ID NO: 463592 - DNA, 524 bp, Homo sapiens
  misc_feature: HEFZJCU01CANA9.21.75.G09.1.454.heavy.3.raw
  modified_base (341)..(341): a, c, t, g, unknown or other
tcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaaggtgtccaatgtgaggtgcagctggtggagtctgggggagatttggtacagccagggcggtccctgagactctcctgtacaacctctggattcaccttttggtgattatgctatgagctggttccgccaggctccagggaagggctggagtgggttggtttcgtcagaagcaaagnttatggtggaacaccagattacgccgcgtctgtgaaagacagattcacaatctcaagagatgattccaaaagcatcgcctatctgcaaatgaacagcctgaagaccgaggacacagccgtgtattactgtactcgagacctcccgtataagtcgggacctgtctttgactacgtggggccaac

SEQ ID NO: 463593 - DNA, 516 bp, Homo sapiens
  misc_feature: HEFZJCU01BG2E9.51.5.A05.1.454.heavy.3.raw
cgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagagtgagttctccctgaggctgacgtctttaagtgtcgctgatacgggtgtctatttctgttgcgagactgcccggtcctgcacctcgtgtggccccaatttggtttaccggcacacaaaatcagggcaagtcctacgacggtctggtaccg

SEQ ID NO: 463594 - DNA, 526 bp, Homo sapiens
  misc_feature: HEFZJCU01AYSP2.16.86.H09.1.454.heavy.3.raw
  modified_base (501)..(501): a, c, t, g, unknown or other
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccactaggtttgacttacgtgggggccaggggaancttggtccaccggtctcctcagcct

SEQ ID NO: 463595 - DNA, 506 bp, Homo sapiens
  misc_feature: HEFZJCU01BSXAS.51.71.G05.1.454.heavy.3.raw
cgatcgtatacacgaccggtgctcgatttagtgtcgtcgcaagagagaggggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttcccctcggcaccctcctccagagcacctctgggggcacagcggccctgggctgcctggtcaaggactacttcc

SEQ ID NO: 463596 - DNA, 496 bp, Homo sapiens
  misc_feature: HEFZJCU01CNM79.51.52.E08.1.454.heavy.3.raw
cgatcgtatacacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagcctggggcctcagtgaaggtctcctgcaagacttctggatacaccttcaccgactactatatgcactgggtgcgacaggcccctggacaagggcttgagtggatgggatggatcgaccctaagaatggtgccacaaactatgcacagactttttcagggctggggtcaccatgaccagcgacacatctagcaacacagtctacatggagttgaccagcctgaccgacacggccgtgtatttttgtgttgagagattttcggacaagtccagagaccccgtgttc

SEQ ID NO: 463597 - DNA, 507 bp, Homo sapiens
  misc_feature: HEFZJCU01EU2U1.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccagactccggtgagcctacggcaggtcggcctttgactttcgtc

SEQ ID NO: 463598 - DNA, 518 bp, Homo sapiens
  misc_feature: HEFZJCU01BF604.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctgggccaaggtacagcggtcaccgtcgcctcagcctccaccaaggcccatcggtcttcccctggcaccctcctccaagagcacctctgggggcacacg

SEQ ID NO: 463599 - DNA, 520 bp, Homo sapiens
  misc_feature: HEFZJCU01C57N0.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaaactcctaactacggtctggacgtctggggccaggggaccaac

SEQ ID NO: 463600 - DNA, 480 bp, Homo sapiens; identical to SEQ ID NO: 445011
  misc_feature: HEFZJCU01AROIH.22.36.D03.1.454.heavy.3.raw

SEQ ID NO: 463601 - DNA, 510 bp, Homo sapiens
  misc_feature: HEFZJCU01DJVE8.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctgggggtggctacgagtactggtacttcgatctctggggccgtggcaccctgctgactgtctcctcagcctccaccaaggcccatcggtcttcccctggcgcctgctccaggagcacctccgagagcacaggccggcccgtcgggcgtcgtcctcggtacgaacggaccttaccg

SEQ ID NO: 463602 - DNA, 522 bp, Homo sapiens
  misc_feature: HEFZJCU01ENWLQ.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaacagttctccctgaagctgagctctgtgactgccgcggacacggccgtgtattactgtgcgaggtcgattgtgatggtaacaactgcttcttactcctttgaccagtgggccggggaacccgtggtcaccgtctcttcagcctccaccaaggcccatcggtcttcccctcggccaccctcctccaagagccacctctcgggggcacagcc

SEQ ID NO: 463603 - DNA, 506 bp, Homo sapiens; identical to SEQ ID NO: 450563
  misc_feature: HEFZJCU01CLDGB.49.49.E05.1.454.heavy.3.raw

SEQ ID NO: 463604 - DNA, 501 bp, Homo sapiens
  misc_feature: HEFZJCU01DY803.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgaaacggccatgtattactgtggaagagacgttggtggctaccgcggggctgaccactgggccgac

SEQ ID NO: 463605 - DNA, 516 bp, Homo sapiens
  misc_feature: HEFZJCU01D2C6H.13.21.B10.1.454.heavy.3.raw
tcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagcctggggggtccctgagactctcctgtcaagcctctgggttcagcttcagtgtatattggatgagctgggtccgccagactccagggaaggggctggagtgggtggccaacataaacacagacggaagtgacccatactatgcggactctgtgaagggccgattcaccatctccagagacaacgccaagaactcactatatttgcaaatggaccgcctgagagacgaggacacggctatgtattactgtgcgagagatgagagtggctacagttggggccggggaaccctgggtcaccggtcaa

SEQ ID NO: 463606 - DNA, 501 bp, Homo sapiens
  misc_feature: HEFZJCU01AV5TB.5.20.B09.1.454.heavy.3.raw
atcagacacgcacgaccggtgctcgatttagtgtagtgtgaaggggagctctgggagacgagcccagcactggaagtcgccggtgtttccattcggtgatcatcactgaacacagaggactcaccatggagtttgggctgaactgggttttcctcgttgctcttttaagaggtgtccactgtcaggtgcaactggtggagtctgggggaggcgtggtccagcctggaacgtccctgagactctcctgtgcagcctctgggttcacctacaataaatatgctatgcactgggcccgccaggctccaggcaaggggctggagtgggtggcagttatctcagacgatgaaagtcataaatactacacagactccgtgaagggccgattcaccatctccagagacaattaccaaaagatgttatatctgcaaatgaacagcctgagacctgaggacacggctgtatattattgtgtgacggggactcaactcgtgggggacccac

SEQ ID NO: 463607 - DNA, 517 bp, Homo sapiens
  misc_feature: HEFZJCU01DM1AD.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagcgtggtttctgttagttattctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatgggtctcagttattcataccgacggtaccatatatgacgcagactccgtgaagggccgattcaccatctccagagaccattccaagaacaccctatatcttcaaatgaacaacctgagagtcgaagacacggccgtatattactgtgcgagacatgacttcggttgacccctggggccagggaaccctggtcaccgtctcctcag

SEQ ID NO: 463608 - DNA, 518 bp, Homo sapiens; identical to SEQ ID NO: 445423
  misc_feature: HEFZJCU01DBB9R.7.78.H01.1.454.heavy.3.raw

SEQ ID NO: 463609 - DNA, 519 bp, Homo sapiens
  misc_feature: HEFZJCU01CD43J.51.5.A05.1.454.heavy.3.raw
  modified_base (380)..(380): a, c, t, g, unknown or other
cgatcgtatacacgaccggtgctcgatttagatagatagacagggggtgctttctgagagtcatgggcctcctgcacaggaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagagtgagttctccctnaggctgacgtctttaagtgtcgctgatacgggtgtctatttctgtgcgagactgcccggtcctgcacctcgtgtggccccaattttggtttacccggcacgacaaaattcagggcagtacctacgaccggtctggtacc

SEQ ID NO: 463610 - DNA, 523 bp, Homo sapiens
  misc_feature: HEFZJCU01E092J.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggtatgtctgggccaaggtacagcggtcaccgtcgcctcagcctccaccaagggcccatccggtcttcccctggcaccctcctccaagagcacctctcggggggcacacg

SEQ ID NO: 463611 - DNA, 519 bp, Homo sapiens
  misc_feature: HEFZJCU01APOLU.48.34.D01.1.454.heavy.3.raw
agtatacatacacgaccggtgctcgatttagatcgtctgtgttgggtttggggatttagatgtctgtgttgggtttggggggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacacgcggcccctgggctgcctggtcaaggactacttcctatgtatta

SEQ ID NO: 463612 - DNA, 518 bp, Homo sapiens
  misc_feature: HEFZJCU01DE84D.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggacctagctgttaaaaactcctactacggtctggacgtctggggccagggaccaa

SEQ ID NO: 463613 - DNA, 513 bp, Homo sapiens
  misc_feature: HEFZJCU01DS3MG.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagcgtggcttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacaactgtatctgcaaatgaacagcctgagagccgacgacacggccatatattactgtgcgaaagcaccggcagttagtcacccatactactttgactactggggccaac

SEQ ID NO: 463614 - DNA, 505 bp, Homo sapiens; identical to SEQ ID NO: 453549
  misc_feature: HEFZJCU01DGE9I.12.33.C11.1.454.heavy.3.raw

SEQ ID NO: 463615 - DNA, 504 bp, Homo sapiens; identical to SEQ ID NO: 445353
  misc_feature: HEFZJCU01AYSAW.10.38.D05.1.454.heavy.3.raw

SEQ ID NO: 463616 - DNA, 535 bp, Homo sapiens
  misc_feature: HEFZJCU01D3MPJ.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgtacccctgggccagggaacccaggtcaccgtctcctcagcctccaccaagggcccatccgtcttccccctcggcgccctgctccaggacgcacctccgagagcacagcggccctcggggctcggcctgggtccaagggactaaccgttccttacc

SEQ ID NO: 463617 - DNA, 512 bp, Homo sapiens; identical to SEQ ID NO: 446702
  misc_feature: HEFZJCU01AVKRZ.14.25.C03.1.454.heavy.3.raw

SEQ ID NO: 463618 - DNA, 512 bp, Homo sapiens
  misc_feature: HEFZJCU01DWNPC.8.42.D09.1.454.heavy.3.raw
ctcgcgtgtccacgaccggtgctcgatttagacacatacgcagggaaagggggggagaggagcccagcactgggattccgaggtgtgtccattcggtgatcagcactgaacacagaggactcaccatggagttctggctgggctgggttttccttgttgcaatttcaaaaggtgtccagtgtgaggtgcagctggtggagaatggagggggcttgatccagccgggggggtccctgagactctcctgtgcagcctctggcttcaccatcagtagagactacatgagctgggcccgccaggctccagggaaggggctggagtgggtctcagttatttatcgcgatggtggcacacactacgcagactccgtgaagggcagattcaccgtctccagagacaattccaagaacatggtgtatcttcaaatgaacagactaacagccgaggacaacggccgtatattactgtgcgagacatgactacggtgacgcccgtggggccagggtaacccg

SEQ ID NO: 463619 - DNA, 519 bp, Homo sapiens; identical to SEQ ID NO: 444867
  misc_feature: HEFZJCU01EWIZH.9.34.D01.1.454.heavy.3.raw

SEQ ID NO: 463620 - DNA, 507 bp, Homo sapiens; identical to SEQ ID NO: 460264
  misc_feature: HEFZJCU01DWC09.18.50.E06.1.454.heavy.3.raw

SEQ ID NO: 463621 - DNA, 478 bp, Homo sapiens
  misc_feature: HEFZJCU01C4KO5.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctcaccaagggcccatcggtcttcccctggcgccctgctccaggagcacctccgagagcacagcggccctgggctgcctggtcaaggactacttccagagtatca

SEQ ID NO: 463622 - DNA, 483 bp, Homo sapiens; identical to SEQ ID NO: 444639
  misc_feature: HEFZJCU01AEB21.11.23.C01.1.454.heavy.3.raw

SEQ ID NO: 463623 - DNA, 518 bp, Homo sapiens; identical to SEQ ID NO: 444718
  misc_feature: HEFZJCU01EG2ZM.9.34.D01.1.454.heavy.3.raw

SEQ ID NO: 463624 - DNA, 519 bp, Homo sapiens
  misc_feature: HEFZJCU01EUALG.4.33.C11.1.454.heavy.3.raw
agcactgtagcacgaccggtgctcgatttagagtgagctcgttgggtttgggggggagaggagcccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatgaacagcctgaagaccgaggacacagccgtctattactgtgttagggtagttttacgtagtttttggtaggtggatatttaa

SEQ ID NO: 463625 - DNA, 487 bp, Homo sapiens
  misc_feature: HEFZJCU01AWZJX.51.6.A06.1.454.heavy.3.raw
cgatcgtatacacgaccggtgctcgatttagatctactgacaggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagcctgggaggtccctgagactctcctgtgaagcctctggattcagcttcagtacgtatggtttgcgctgggtccgccaggctccaggcaagggactgcagtgggtggcatctatatcatatgaaggaagcaataaatactacgcagactccgtgaagggccgattcaccatctccagagacaatcccaagaacacactttatctgcaaatgaaccaccctgagacttgaggacacggctgtctatttattgtgcgagagggagatcg

SEQ ID NO: 463626 - DNA, 511 bp, Homo sapiens
  misc_feature: HEFZJCU01BZBYV.10.85.H08.1.454.heavy.3.raw
  modified_base (499)..(499): a, c, t, g, unknown or other
catagtagtgcacgaccggtgctcgatttagtatcactcagtcgcgggtgaccgtgacctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttcccccaaaacccaaggacaccctcatgatctcccggacccctgaggtcacgtgcgtggtggtggacgtgagccacgaagaccccgaggtccctgagactctcctgtggagcgtccggattcgactttgatacttattggatgagctgggtccgccaggctccagggaagggctggagtgggtggccaccataaaggagatggaagtgagaactactttgtgggctctgtgaagggccgattcaccatctccagagacaacgccaagagtcactgtatctgcaaatgaacgntgtgagagtcga

SEQ ID NO: 463627 - DNA, 506 bp, Homo sapiens; identical to SEQ ID NO: 444696
  misc_feature: HEFZJCU01CVGZ1.16.34.D01.1.454.heavy.3.raw

SEQ ID NO: 463628 - DNA, 531 bp, Homo sapiens
  misc_feature: HEFZJCU01DF405.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttggggccagggaaccctggtcaccgtctcctcagcctccaccaagggcccatcggtcttcccctggcaccctcctccaagagcacctctgggggcacagcggccctgggctgcct

SEQ ID NO: 463629 - DNA, 400 bp, Homo sapiens; identical to SEQ ID NO: 444452
  misc_feature: HEFZJCU01DLN57.47.24.C02.1.454.heavy.3.raw

SEQ ID NO: 463630 - DNA, 543 bp, Homo sapiens
  misc_feature: HEFZJCU01BLTPH.12.85.H08.1.454.heavy.3.raw
  modified_base (471)..(471): a, c, t, g, unknown or other
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagcgtggcttttcttggtggctttttaaaaggtgcccagtgtgaggtgcaactgttggagtctgggggaggcttggtacagccggggggtccctgagactctcctgtgcagcctctggattcaattttaacagctttgccatgggctgggtcccgccaggctccagggaaggggctggagtgggtctcgaatattaatgaaaggggtgataacacatactatgcggactctgtaaggggccggttcaccatctccagagacaattccaagaaacactgtatctgcaattaaccagcctgagagtcgaggacacggccctttatactgtncgaaggatcgcccctataatggtggttggatcggggagtttggttccgtgggccgagggaacctggtcaccg

SEQ ID NO: 463631 - DNA, 507 bp, Homo sapiens
  misc_feature: HEFZJCU01BCR7R.13.37.D04.1.454.heavy.3.raw
tcacgtactacacgaccggtgctcgatttagtagcatactgttgggtttgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattgtaatgatggtagctgctactacactttttgactactggggccagggaaccctggtcaccgtctcttcagcctccaccaagggcccatcggtcttccccctggcaccctcctccaagagcacctctgggggcacagcggccctgggctgcctggtcaaggactacttccgtactagacg

SEQ ID NO: 463632 - DNA, 481 bp, Homo sapiens
  misc_feature: HEFZJCU01A9VU5.11.63.F08.1.454.heavy.3.raw
  modified_base (427)..(427): a, c, t, g, unknown or other
cgagagataccacgaccggtgctcgatttagcgatcgtataagggggcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcactgggtgcgacaggcccctggacaagggcttgagtggatgggacggatcaaccctaatagtggtggcacaaactatgcacagaagtttgagggcagggtcatcatgaccagggacacgtccatcagcacagcctacatggagctgagcgagcgtgaacgntctagacgacacggccgtgtattactgtgcgagagataaggggatgtgatagta

SEQ ID NO: 463633 - DNA, 540 bp, Homo sapiens
  misc_feature: HEFZJCU01D91MY.51.26.C04.1.454.heavy.3.raw
cgatcgtatacacgaccggtgctcgatttagtctagcgactttgggtttgggctgagcggtggtttcgtcgtaggcgtctttaagtaggtgtccagtgtcaggtgcacctggtggagtctggggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactgggtacggggagttaccttcctccgcaacggtatggacgtctggggccaagggaccacggtcaccgtctccttagcctccaccaagggcccatcggtcttccccctggccaccctcctccaagagccacctctc

SEQ ID NO: 463634 - DNA, 428 bp, Homo sapiens
  misc_feature: HEFZJCU01AGYKT.9.34.D01.1.454.heavy.3.raw
tgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagccggccctgggctgcctggtcaaggactacttccagacgtatca

SEQ ID NO: 463635 - DNA, 516 bp, Homo sapiens
  misc_feature: HEFZJCU01A09OP.51.26.C04.1.454.heavy.3.raw
cgatcgtatacacgaccggtgctcgatttagtctagcgactttgggtttggggtctgggagacgagcccagcactggaagtcgccggtgtttccattcggtgatcatcactgaacacagacatggagtttgggctgagcgtgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaatgaacagcctgagagctgaggacagggctgtttattactgtgtgcgatccgacctcactggtacggggagttacttcctccgcaacggtat

SEQ ID NO: 463636 - DNA, 528 bp, Homo sapiens
  misc_feature: HEFZJCU01ERKTS.2.53.E09.1.454.heavy.3.raw
  modified_base (398)..(398): a, c, t, g, unknown or other
acgctcgacacacgaccggtgctcgatttagagagagtgtgttgggtttggggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctgggtgcgacaggcccctggacaagggcttgagtggatgggatggatcagtgcttacaacggtaacacaaactatgcacagaagttccagggcagagtcaccctgaccacagacacatccacgagcacagtcaacctggacctgaggagcctgacatctnacgacacggccgtgtattattgtgcgagaggacggagggggggaggcgacgtccttttgtacgtaccttgggggccaggggaacccgtggtcgacccggtctcctcagccctccacccgaagggaccccg

SEQ ID NO: 463637 - DNA, 511 bp, Homo sapiens; identical to SEQ ID NO: 446224
  misc_feature: HEFZJCU01DJRLU.7.28.C06.1.454.heavy.3.raw

SEQ ID NO: 463638 - DNA, 468 bp, Homo sapiens; identical to SEQ ID NO: 448722
  misc_feature: HEFZJCU01DMASY.4.10.A10.1.454.heavy.3.raw

SEQ ID NO: 463639 - DNA, 492 bp, Homo sapiens; identical to SEQ ID NO: 444827
  misc_feature: HEFZJCU01BAK0O.4.28.C06.1.454.heavy.3.raw

SEQ ID NO: 463640 - DNA, 511 bp, Homo sapiens
  misc_feature: HEFZJCU01CGMB0.21.27.C05.1.454.heavy.3.raw
tcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaatgtcgctggcaacaatggttggaattggattaggcagtccccgtcgagaggccttgagtggcttggaaggacctattatacgtcccagtggtatgaagactatgcagattctgtgagcggtcgtctcaccatcaccccagacacgtccaagaatcaggtctccctccacctaatgtctgtcactcccgacgacacggcagttttattttgtgcaaagaggatcacattcggtgactacctccttgactcctggggccagggtacg

SEQ ID NO: 463641 - DNA, 508 bp, Homo sapiens
  misc_feature: HEFZJCU01D2JFW.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaagggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcctacccatactactttgactactgggg

SEQ ID NO: 463642 - DNA, 518 bp, Homo sapiens
  misc_feature: HEFZJCU01EI12E.40.43.D10.1.454.heavy.3.raw
tctagcgactcacgaccggtgctcgatttagactagcagtaagggggctctgagagaggagcccagccctgggattttcaggtgttttcatttggtgatcaggactgaacagagagaactcaccatggagtttgggctgagctggcttttcttgtggctattttaaaaggtgtccagtgtgaggtgcagttgttggagtctgggggagcttggcacagcctggggggtcccggagactctcctgtgcagcctctggattcgcctttcagaactctgccatgcactgggtccgccagcctccagggaaggggctggagtgggtctcaggtattcggggtgatggtactgacacatactacgcagactctgcgaagggccggttcaccatctccagagacatttccaagaacacactctatctgcaaatgaccaacctcagaggcgaggacacggccatatattactgtgcggaaaggtggtgactatgaccgactggggccaggggaaccctggtaccg

SEQ ID NO: 463643 - DNA, 518 bp, Homo sapiens
  misc_feature: HEFZJCU01CS4V6.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctcccagcctcaccaagggcccatcggtctcccctggcg

SEQ ID NO: 463644 - DNA, 478 bp, Homo sapiens; identical to SEQ ID NO: 448105
  misc_feature: HEFZJCU01CVS5N.26.78.H01.1.454.heavy.3.raw

SEQ ID NO: 463645 - DNA, 509 bp, Homo sapiens
  misc_feature: HEFZJCU01ET07Q.13.67.G01.1.454.heavy.3.raw
tcacgtactacacgaccggtgctcgatttagagtatacatattgggtttggggtctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgcaaaagataccaaccccttacgtactttttggt

SEQ ID NO: 463646 - DNA, 526 bp, Homo sapiens
  misc_feature: HEFZJCU01EYLF1.48.34.D01.1.454.heavy.3.raw
agtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactgggccgagggaaccctggtcaccgtctcctcagcctccaccaagggcccatcggtcttcccctggcgccctcgctccaggagcacctccgagagcacagccggccctcggggctcggccttggtcaacgggactacctttaccg

SEQ ID NO: 463647 - DNA, 495 bp, Homo sapiens
  misc_feature: HEFZJCU01CC0HY.10.71.G05.1.454.heavy.3.raw
  modified_base (466)..(466): a, c, t, g, unknown or other
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtntttattactgtgggagaaatcctagtggc

SEQ ID NO: 463648 - DNA, 396 bp, Homo sapiens; identical to SEQ ID NO: 444469
  misc_feature: HEFZJCU01BXW4P.47.46.E02.1.454.heavy.3.raw

SEQ ID NO: 463649 - DNA, 383 bp, Homo sapiens; identical to SEQ ID NO: 451998
  misc_feature: HEFZJCU01DC66W.11.61.F06.1.454.heavy.3.raw

SEQ ID NO: 463650 - DNA, 479 bp, Homo sapiens
  misc_feature: HEFZJCU01B2QNO.19.67.G01.1.454.heavy.3.raw
tactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctggtggacagatcactggggccagggaaccctggtcaccgtctcctcagcctccacaagggcccatcggtcttcccctggcgccctgctccaggagcacctccgagagcacagcggccctgggctgcctggtcaaggactacttcccacgagagta

SEQ ID NO: 463651 - DNA, 512 bp, Homo sapiens; identical to SEQ ID NO: 447721
  misc_feature: HEFZJCU01AMF5Y.17.33.C11.1.454.heavy.3.raw

SEQ ID NO: 463652 - DNA, 507 bp, Homo sapiens
  misc_feature: HEFZJCU01EJXCF.10.38.D05.1.454.heavy.3.raw
catagtagtgcacgaccggtgctcgatttagtatctgatagttgggtttggggggagaggagtccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggcccacctattattgtgcgcgacatgactacgctcaattctggggccaggggacg

SEQ ID NO: 463653 - DNA, 384 bp, Homo sapiens; identical to SEQ ID NO: 444454
  misc_feature: HEFZJCU01BWF31.11.61.F06.1.454.heavy.3.raw

SEQ ID NO: 463654 - DNA, 511 bp, Homo sapiens
  misc_feature: HEFZJCU01E1XQH.17.25.C03.1.454.heavy.3.raw
  modified_base (479)..(479): a, c, t, g, unknown or other
cgtagactagcacgaccggtgctcgatttagtagtgtagatttgggtttggggacgtcaacaaccacatctgtcctctagagaaaaccctacgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatccgtccgggacagacttaccatgaccacgaactcctccataaacacagcctacatggagttgaggagcctgacatctgacgacacggccgtctattactgtgcgagagtcccacgatccggtnacgcctacggcagccggtcctttgacttcgtc

SEQ ID NO: 463655 - DNA, 480 bp, Homo sapiens; identical to SEQ ID NO: 451411
  misc_feature: HEFZJCU01BI3LX.4.37.D04.1.454.heavy.3.raw

SEQ ID NO: 463656 - DNA, 518 bp, Homo sapiens
  misc_feature: HEFZJCU01APHB8.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtcggggcccacggaacgttactacgctatggacgtctggggaccg

SEQ ID NO: 463657 - DNA, 501 bp, Homo sapiens
  misc_feature: HEFZJCU01EU9J0.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttcgtggggcc

SEQ ID NO: 463658 - DNA, 498 bp, Homo sapiens
  misc_feature: HEFZJCU01CW0I4.53.61.F06.1.454.heavy.3.raw
cgcgtatacacacgaccggtgctcgatttagctacgctctaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacacgtccatcagcactgcctacatggagctgaccaggctgaaatttgaggacacggccatttattactgtgcaaggaacagcataatgactcgtcccccggactttgta

SEQ ID NO: 463659 - DNA, 509 bp, Homo sapiens
  misc_feature: HEFZJCU01CTE9V.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagcctggggggtccctgagactctcctgtgcagcctctgggttcagtcatcagtaacgactacatgacctgggcccgccaggctccgagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggacg

SEQ ID NO: 463660 - DNA, 397 bp, Homo sapiens; identical to SEQ ID NO: 444534
  misc_feature: HEFZJCU01DH047.18.1.A01.1.454.heavy.3.raw

SEQ ID NO: 463661 - DNA, 423 bp, Homo sapiens; identical to SEQ ID NO: 444772
  misc_feature: HEFZJCU01DN5JO.16.78.H01.1.454.heavy.3.raw

SEQ ID NO: 463662 - DNA, 492 bp, Homo sapiens; identical to SEQ ID NO: 445919
  misc_feature: HEFZJCU01DU69A.14.25.C03.1.454.heavy.3.raw

SEQ ID NO: 463663 - DNA, 396 bp, Homo sapiens; identical to SEQ ID NO: 444469
  misc_feature: HEFZJCU01EX901.47.46.E02.1.454.heavy.3.raw

SEQ ID NO: 463664 - DNA, 513 bp, Homo sapiens
  misc_feature: HEFZJCU01DHS38.51.29.C07.1.454.heavy.3.raw
cgatcgtatacacgaccggtgctcgatttagagtgctacgaagggaaaggggaggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagttgctgggaaggacatactacaggtccaagtggtttaatgattatgcagtatctgtgaaaagtcgaataaccatcaacccagacacatccaagaaccagttctccctgcaactgaactctgtgactcccgaggacacggccgtgtattactgtgcaagaggttggttaacagctggaggatttgactactggggccagggaaccctggtcaccgtctcctcagcctccaccaagggcccatcggtcttcccccgtggccgccctcgctccaggagcacctccgagagcacagcggccccgtggg

SEQ ID NO: 463665 - DNA, 501 bp, Homo sapiens
  misc_feature: HEFZJCU01CHXS6.51.71.G05.1.454.heavy.3.raw
cgatcgtatacacgaccggtgctcgatttagtgtcgtcgcaagagagaggggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaacg

SEQ ID NO: 463666 - DNA, 505 bp, Homo sapiens
  misc_feature: HEFZJCU01BRSHS.48.34.D01.1.454.heavy.3.raw
agtatacatacacgaccggtgctcgatttagatcgtctgtgttgggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttccccttcggcgccctgctccaggagcacctccgagagcacagcggccctgggctgcctggtcgaaggactacttcctactgtatact

SEQ ID NO: 463667 - DNA, 517 bp, Homo sapiens; identical to SEQ ID NO: 461388
  misc_feature: HEFZJCU01EW944.8.33.C11.1.454.heavy.3.raw

SEQ ID NO: 463668 - DNA, 496 bp, Homo sapiens
  misc_feature: HEFZJCU01EYEHY.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtgcggtgactgctattgactactggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 463669 - DNA, 520 bp, Homo sapiens; identical to SEQ ID NO: 448229
  misc_feature: HEFZJCU01BGBIF.12.86.H09.1.454.heavy.3.raw

SEQ ID NO: 463670 - DNA, 540 bp, Homo sapiens
  misc_feature: HEFZJCU01EOYW0.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggccgtttcatgtctggggccaagggacgctggtcaccgtctcttcagcctccaccaagggcccatcggtcttcccctcggcaccctccctccaagagcacctctgggggcacagcc

SEQ ID NO: 463671 - DNA, 515 bp, Homo sapiens
  misc_feature: HEFZJCU01EFSC0.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggcccgcaacagactacggtggcaactcctatgcttttgatatctgggccaagggacaatggtcaccgtctcttcagcctccaccaagggcccatcggtcttcccctggcaccctcctccaagagcacctctgggggcacagcggcccg

SEQ ID NO: 463672 - DNA, 379 bp, Homo sapiens; identical to SEQ ID NO: 444450
  misc_feature: HEFZJCU01A5D30.47.77.G11.1.454.heavy.3.raw

SEQ ID NO: 463673 - DNA, 505 bp, Homo sapiens; identical to SEQ ID NO: 447076
  misc_feature: HEFZJCU01AHBRH.10.38.D05.1.454.heavy.3.raw

SEQ ID NO: 463674 - DNA, 487 bp, Homo sapiens
  misc_feature: HEFZJCU01ENPG4.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctgcgcctgctccaggagcacctccgagagcacagcggccctgggctgcctggtcaaggactacttcccatactcgta

SEQ ID NO: 463675 - DNA, 491 bp, Homo sapiens
  misc_feature: HEFZJCU01DBLAB.51.27.C05.1.454.heavy.3.raw
  modified_base (474)..(474): a, c, t, g, unknown or other
cgatcgtatacacgaccggtgctcgatttagacgcgatcgaagggtttggggagctctgggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtacaccctctggattcaccttcagtaactatgcaatgcactgggtccgccaggctccaggcaaggggctggactgggtggcaggtatatcatatgatggaagcaataaatactacgcagactccgtgaagggccgattcaccatctccagagacagttccgatgacacagtctatctgcaaatgaacagcctgagagctgaggacacggcttctttttacngttgcgccgaaggacgc

SEQ ID NO: 463676 - DNA, 506 bp, Homo sapiens
  misc_feature: HEFZJCU01CLO1F.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctgggtcatcgtctcctcagctccaccaagggcccatcggtcttcccctggcacctcctccaacgagcacctctgggggcacagcggccctgggctgcctggtcaaggactacttccgagtagtaca

SEQ ID NO: 463677 - DNA, 492 bp, Homo sapiens
  misc_feature: HEFZJCU01A2WT2.51.64.F09.1.454.heavy.3.raw
cgatcgtatacacgaccggtgctcgatttagcgcgtatacaagggggggagaggagcccagcactagaagtcggcggtgtttccattcggtgatcagcactgaacacagaggactcaccatggagtttgggctgagctgggttttcctcgtcgttcttataagaggtgtccagtctgaggcgcagctggtggagtctgggggaggagtggtccagcctgagaggtccttgagactctcctgtgcagcctctggattcaccttcagagtctatggcatgaactgggtccgccaggctccaggcaaggggctggagtgggtggcattcatttcagaggatggaattaagagatactatacagactccgtgaagggccgattcaccatctccagagacaattccaagaactcgctctatctgcaaatgagcagcctgagacctgaggacacggctgtctattactgtgcgaaacgatgagtggaactagggttga

SEQ ID NO: 463678 - DNA, 499 bp, Homo sapiens
  misc_feature: HEFZJCU01C5VUU.40.68.G02.1.454.heavy.3.raw
tctagcgactcacgaccggtgctcgatttagtcgatagtgaagggaaaggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaagggctggagtggattgggagtatttaccacagtgggagcacctactacaacccgtccctcaaaagtcgaggcaccatatccgtagacacgtccaagaccaattctccctgaagctgagctctgtgaccgccgcagacacggctgtctattactgtgcgaggccccgagcgcagtggcttttgatgcctttgatatgtgggccaaggacaatggtcaccg

SEQ ID NO: 463679 - DNA, 518 bp, Homo sapiens; identical to SEQ ID NO: 444718
  misc_feature: HEFZJCU01CJGVJ.9.34.D01.1.454.heavy.3.raw

SEQ ID NO: 463680 - DNA, 382 bp, Homo sapiens
  misc_feature: HEFZJCU01BRRDX.11.61.F06.1.454.heavy.3.raw
cgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccagggaaccctggtcaccgtctcctcagcctccaccaagggcccatcggtcttccccctggcaccctcctccaagagcacctctggggcacagcggccctgggctgcctggtcaaggactacttccgtatctctcg

SEQ ID NO: 463681 - DNA, 400 bp, Homo sapiens; identical to SEQ ID NO: 463283
  misc_feature: HEFZJCU01EFEJ3.16.80.H03.1.454.heavy.3.raw

SEQ ID NO: 463682 - DNA, 519 bp, Homo sapiens
  misc_feature: HEFZJCU01AP7NG.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggcccgattcaccatctccagagacaattccaagaacacgctgtttcttcaaatgaacagcctgagagccgatgacacggccgtgtattactgtgcgagagatggggcccacgaacgttactacgctatggacgtcgtggggccaagggacc

SEQ ID NO: 463683 - DNA, 514 bp, Homo sapiens; identical to SEQ ID NO: 446516
  misc_feature: HEFZJCU01CUPLM.12.55.E11.1.454.heavy.3.raw

SEQ ID NO: 463684 - DNA, 507 bp, Homo sapiens
  misc_feature: HEFZJCU01CKE3O.51.21.B10.1.454.heavy.3.raw
cgatcgtatacacgaccggtgctcgatttagtgtcgtcgcaagggggagggcatcatccaacaaccacatcccttctctacagaagcctctgagaggaaagttcttcaccatggactggacctggagggtcttctgcttgctggctgtagctccaggtgctcactccctggtgcagctggtgcagtctggggctgaggtgaagaagcctggggcctcagtgacgatttcctgtaggacatctggatacacgttcaccggctattttatgtactgggtgcgacaggcccctggacaaggccttgagtggatgggaaagatcaaccctagtggtggtaccacaagttacgcccagaaattccagggcagagtctccatgaccagaaatacgtccgcgaggacagtctacatggagttgagcagcctgagaaactgaacgacacggccatatattactgtgcgagagaccttgctggtccttttgacttctggggccagggaccctggtc

SEQ ID NO: 463685 - DNA, 499 bp, Homo sapiens; identical to SEQ ID NO: 447220
  misc_feature: HEFZJCU01CRC2Y.12.14.B03.1.454.heavy.3.raw

SEQ ID NO: 463686 - DNA, 518 bp, Homo sapiens; identical to SEQ ID NO: 445220
  misc_feature: HEFZJCU01CZB7I.9.70.G04.1.454.heavy.3.raw

SEQ ID NO: 463687 - DNA, 526 bp, Homo sapiens
  misc_feature: HEFZJCU01CHA7L.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagaccgacacggctgtctattattgcgcgagagagacacacgaacctacctggccaatactatgggggcttgttctggggccaggggaccctggtcatcgtctctccagcctccaccaagggcccatcggtcttcccctggcgccc

SEQ ID NO: 463688 - DNA, 529 bp, Homo sapiens
  misc_feature: HEFZJCU01EAF72.3.82.H05.1.454.heavy.3.raw
agacgcactccacgaccggtgctcgatttagtcgagctctctcgcgggggggaggggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctgggagtgggtctcagttatttacaattctggtaccacatactactccgaccccgtgaagggccgattaaccatctccagagacgattccgagaacacggtgtatcttcaaatgaacaacctgagagccgacgacacggcccgtttattactgtgcgagagattcgagtgggttcggggacctcaccctggttctacttcgatctcgtgggccgtgg

SEQ ID NO: 463689 - DNA, 518 bp, Homo sapiens
  misc_feature: HEFZJCU01EC0BU.52.9.A09.1.454.heavy.3.raw
cgcagtacgacacgaccggtgctcgatttagcgagacgcgcagggggctctgggagaggagccccagccgtgagattcccaggagtttccacttggtgatcagcactgaacacagaccaccaaccatggagtttgggcttagttgggttttccttgttgctattttaaaaggtgtccagtgtgaggtgcagctggtggagtctgggggaggcttggtacagccagggcggtccctgagactctcctgtacagcttctggattcacctttggtgattatgctatgacatgggtccgccaggctccggggaagggctggagtgggtaggtttctctagaagcaaatcctatggtgggacaacagaatacgccgcgtctgtggaaggcagattcaccatctcaagagatgattccaaaggcatcgcctatctgcaaatgaagagcctgaaaaccgaggacacagccgtgtacttctgtactagagtcttcttgtatttattatgaaactagtggttattca

SEQ ID NO: 463690 - DNA, 500 bp, Homo sapiens
  misc_feature: HEFZJCU01B7D6B.48.59.F04.1.454.heavy.3.raw
agtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtgggccagggacaatgtcaccgt

SEQ ID NO: 463691 - DNA, 522 bp, Homo sapiens
  misc_feature: HEFZJCU01COL33.49.14.B03.1.454.heavy.3.raw
agtcgagagacacgaccggtgctcgatttagtgtgagtagttccgcgggcacgaccggtgctcgatttagtgtgagtagttccgcgggcacgaccggtgctcgatttagtatctgatagttgggtttggggacccaacaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagaagtcaccattacccgagacacttccgcgaacacagcctacatggaactgagcggcctgagatttgaagacacggctgtgtta

SEQ ID NO: 463692 - DNA, 520 bp, Homo sapiens
  misc_feature: HEFZJCU01CB1ND.52.78.H01.1.454.heavy.3.raw
cgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggttgttgtcgttgcaccagctgccctaccggctgctacttcgatctctggggccgtggcaccctggtcactgtcttctcagcctccaccaagggcccatcggtcttccccctggcaccctcctccaagacgcacctcgtggggcacagcggccctgggctgcctggtacgaaggactacttcctatacg

SEQ ID NO: 463693 - DNA, 324 bp, Homo sapiens; identical to SEQ ID NO: 444475
  misc_feature: HEFZJCU01C6DV1.18.17.B06.1.454.heavy.3.raw

SEQ ID NO: 463694 - DNA, 512 bp, Homo sapiens
  misc_feature: HEFZJCU01COO48.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttcgtggggccagggaaccctc

SEQ ID NO: 463695 - DNA, 379 bp, Homo sapiens; identical to SEQ ID NO: 444450
  misc_feature: HEFZJCU01EZN6A.47.77.G11.1.454.heavy.3.raw

SEQ ID NO: 463696 - DNA, 509 bp, Homo sapiens
  misc_feature: HEFZJCU01B87GN.22.82.H05.1.454.heavy.3.raw
acatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtctgggggaggcctggtacagccgggggggtccctgagactctcctgtgtagcctccggattcacctttagcagacatggcatgagctgggtccgccaggctccagggaagggccggagtgggtgtcagtcattagtagtagtggtgatagaatttaccacacagactccgtgaagggccgcttcaccatctctagagacaattcccagaacacactgtatctgcaaatgactaggctgagagccgacgacacggccatttattactgcgcgaaggatatacgggtcacgaacggtggctacggcgttt

SEQ ID NO: 463697 - DNA, 494 bp, Homo sapiens
  misc_feature: HEFZJCU01CGMFI.13.86.H09.1.454.heavy.3.raw
tcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggactaggactcgagtggatgggatggatcagcccttacaacggaaacacagactatggacagaacctccagggcagattcaccatgacgacagacacatacacgaacacagcctacatggaggtgaggagcctgagatatgacgacacggccgtgtattattgtgcgagagtggagtggcagtggatatcgacaaattactactta

SEQ ID NO: 463698 - DNA, 502 bp, Homo sapiens
  misc_feature: HEFZJCU01DVGFS.53.81.H04.1.454.heavy.3.raw
  modified_base (468)..(468): a, c, t, g, unknown or other
cgcgtatacacacgaccggtgctcgatttagtagtgtagattcgcggggctgggagacgagcccagcactggaagtcgccggtgtttccattcggtgatcatcactgaacacagaggactcaccatggagtttgggctgagctgggttttcctcgttgctcttttaagaggtgtccagtgtcaagtgcaactggtggagtctgggggaggcgtggtccagcctggggggtccctgagactctcctgtgcagcctctggattcaccttcagcacctatcctatgcactgggtccgccaggctccaggcaagggactggagtgggtggcagttatatcatttgatggaagcactacatactacgcaaactccgtgaagggccgattcaccatctccagagacgattccaggaacactctgtttctccaaatgaacagcctgagagctgaggacacggctctttatttacngtgcgagagattctggatacagccattatttacg

SEQ ID NO: 463699 - DNA, 504 bp, Homo sapiens
  misc_feature: HEFZJCU01EV2QR.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaagggctggagtggctcgcacttatttacagtggcggcactacatactacacagacttcgcgaggggccgattcaccatctccagagacgattccaagaacacgttgtatcttcaaatgaacagcctgacagtcgacgacacggccatgtattttgtgcgagcgaccggggctcctcaatgctttcattacg

SEQ ID NO: 463700 - DNA, 516 bp, Homo sapiens
  misc_feature: HEFZJCU01A0DHM.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggtattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctgggccagggaaccctggtcaccgtctcctcagcctccaccaagggcccatcggtcttcccctggcaccctcctccaagagcacctctggggcacagcggccctggctgcctggtcaggactactccgagtagtacacg

SEQ ID NO: 463701 - DNA, 500 bp, Homo sapiens; identical to SEQ ID NO: 460239
  misc_feature: HEFZJCU01EMZWA.11.41.D08.1.454.heavy.3.raw

SEQ ID NO: 463702 - DNA, 506 bp, Homo sapiens
  misc_feature: HEFZJCU01DMRWC.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggacccacggtcatcgtctcctcagcctccaccaagggcccatcggtcttccccctggcaccctcctccaagagcacctctgggggcacagcggccctgggctgcctggtcaggactacttcctacgtcgtat

SEQ ID NO: 463703 - DNA, 517 bp, Homo sapiens
  misc_feature: HEFZJCU01DT870.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctcgggggcacagcggccctgggctgcctggtcaaggactacttccagacgta

SEQ ID NO: 463704 - DNA, 390 bp, Homo sapiens
  misc_feature: HEFZJCU01CODID.18.31.C09.1.454.heavy.3.raw
tacgagtatgcacgaccggtgctcgatttagacgtctcatcaaggaaggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactggggccagggaaccctagtcaccgtcgccgcagcctccaccaagggcccatcggtcttccccctggcgccctgctccaggagcacctccgagacggccctgggctgcctggtcaaggactacttcccatactcgta

SEQ ID NO: 463705 - DNA, 518 bp, Homo sapiens; identical to SEQ ID NO: 449255
  misc_feature: HEFZJCU01BBPXO.3.17.B06.1.454.heavy.3.raw

SEQ ID NO: 463706 - DNA, 501 bp, Homo sapiens
  misc_feature: HEFZJCU01ES2QJ.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctaggaaatgaacaatctgagagtcgacgatacggctgtctatctattgttgttttcgatgtccttcggtcccgcgggtacttcgt

SEQ ID NO: 463707 - DNA, 501 bp, Homo sapiens
  misc_feature: HEFZJCU01ECTAL.13.85.H08.1.454.heavy.3.raw
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtcttgagtggatgggactaatcactcccaatggtgatgggactgcctacgcacagaagtttcagggcagagtcaccatgaccagggacacgtccacgagaacagactatttggaagttgagcagcctgagatctgacgacacggccgtttattactgtgcgtcgagataatagtcacaactggaacggcgttttggggtgttc

SEQ ID NO: 463708 - DNA, 379 bp, Homo sapiens; identical to SEQ ID NO: 444450
  misc_feature: HEFZJCU01AOUCJ.47.77.G11.1.454.heavy.3.raw

SEQ ID NO: 463709 - DNA, 517 bp, Homo sapiens; identical to SEQ ID NO: 446078
  misc_feature: HEFZJCU01CR57X.9.34.D01.1.454.heavy.3.raw

SEQ ID NO: 463710 - DNA, 531 bp, Homo sapiens
  misc_feature: HEFZJCU01A5AQK.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttggggccagggaaccctggtcaccgtctcctcagcctccaccaagggcccatcggtcttcccctggccacctcctccaagagcacctctggggcacagcggccctgggctgcctc

SEQ ID NO: 463711 - DNA, 467 bp, Homo sapiens; identical to SEQ ID NO: 454435
  misc_feature: HEFZJCU01AV5TO.9.34.D01.1.454.heavy.3.raw

SEQ ID NO: 463712 - DNA, 538 bp, Homo sapiens
  misc_feature: HEFZJCU01ER62H.17.28.C06.1.454.heavy.3.raw
  modified_base (371)..(371): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgnggactctgtgaagggccgtttcaccatctccagagacaacgccaagaattcactgtatctacaactgaacagcctgagagtcgcagacacggccgtgtattactgtgcgagatgtggaaaaagtatggctgtgttttattgggggccaggggagccctggtctaccg

SEQ ID NO: 463713 - DNA, 516 bp, Homo sapiens; identical to SEQ ID NO: 445479
  misc_feature: HEFZJCU01AFBE0.9.34.D01.1.454.heavy.3.raw

SEQ ID NO: 463714 - DNA, 537 bp, Homo sapiens
  misc_feature: HEFZJCU01B90SU.2.4.A04.1.454.heavy.3.raw
acgctcgacacacgaccggtgctcgatttagagtagtgatcagggggctttctgagagtcatggatctcatgtgcaagaaaatgaagcacctgtggttcttcctcctgctggtggcggctcccagatgggtcctgtcccagctgcagttgcaggagtcgggcccaggactggtgaagccttcggagaccctgtccctcacctgcactgtctctggtgcctccatcagcagtagtagttattactggggctggattcgccagcccccagggaaggggctggagtggattgggagtttctattatggtgggggaacctactacaacccgtccctcaagagtcgagtcaccgtatccttagacacgtccaagaaccaattctccctgaaactgaactctatgaccgccgcagacacggctgtttattattgtacgggccgtgtaacgttggactactggggccagggagccgtggtcaccgtctcctcagcctccaccaagggcccatcggtcttcccctggccaccctcctccaagacg

SEQ ID NO: 463715 - DNA, 535 bp, Homo sapiens
  misc_feature: HEFZJCU01EPH9H.48.44.D11.1.454.heavy.3.raw
agtatacatacacgaccggtgctcgatttagcgcagtacgaaggggctgggagaggagctccagccttgggactcccagctgtctccactcggtgatcggcactgaatacaggagactcaccatggagtttgggctgagctgggttttccttgttgctattttaaaaggtgtccagtgtgaggtgcagttggtgcagtccgggggaggcttggtccagcctggggggtccctgaaactctcctgtacagcctctgggttcgccttcacagcctctgggttcagcttcagtgcctctgctatgcactgggtccgccaggcttccgggagagggcttgagtggggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctagttggggccac

SEQ ID NO: 463716 - DNA, 494 bp, Homo sapiens
  misc_feature: HEFZJCU01AJRT5.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagagtggaggtcgatagttgt

SEQ ID NO: 463717 - DNA, 500 bp, Homo sapiens
  misc_feature: HEFZJCU01DLU6L.11.73.G07.1.454.heavy.3.raw
cgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggaggcttggtacagcctggacggtccctgagactctcctgtgcagcctctggatacatcttcaaaagtttcgaaatgagctgggtccgccaggctcctgggaaggggccggagtggatttcatacatcagtagtagtggtaacaccttgtactatgcagactctgtgaagggccgattcaccatctccagagacaacgccaagaattcactgtttctgcaaatgaacagcctgagagacgaggatacggctatttactattgtgcgcgatcgacagaaaagcggtaggcctagtc

SEQ ID NO: 463718 - DNA, 518 bp, Homo sapiens
  misc_feature: HEFZJCU01D9CCZ.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctgttctacttcgatctctc

SEQ ID NO: 463719 - DNA, 490 bp, Homo sapiens; identical to SEQ ID NO: 447239
  misc_feature: HEFZJCU01D7WMF.11.26.C04.1.454.heavy.3.raw

SEQ ID NO: 463720 - DNA, 516 bp, Homo sapiens
  misc_feature: HEFZJCU01CH0UD.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaccgacgacacggccgtctattattgtgtcatagacctaggatacaacgacggtgtacctggtattc

SEQ ID NO: 463721 - DNA, 504 bp, Homo sapiens; identical to SEQ ID NO: 454080
  misc_feature: HEFZJCU01EGYIP.47.55.E11.1.454.heavy.3.raw

SEQ ID NO: 463722 - DNA, 489 bp, Homo sapiens
  misc_feature: HEFZJCU01AULCL.13.1.A01.1.454.heavy.3.raw
tcacgtactacacgaccggtgctcgatttagacgtctcatcaggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacagactatggacagaacctccagggcagattcaccatgacgacagacacatacacgaacacagcctacatggaggtgaggagcctgagatatgacgacacggccgtgtattattgtgcgagagtggagtggcagtggatatcgacaaattactactatta

SEQ ID NO: 463723 - DNA, 400 bp, Homo sapiens; identical to SEQ ID NO: 444452
  misc_feature: HEFZJCU01AMLB8.47.24.C02.1.454.heavy.3.raw

SEQ ID NO: 463724 - DNA, 511 bp, Homo sapiens; identical to SEQ ID NO: 445840
  misc_feature: HEFZJCU01EA04B.11.13.B02.1.454.heavy.3.raw

SEQ ID NO: 463725 - DNA, 511 bp, Homo sapiens; identical to SEQ ID NO: 446224
  misc_feature: HEFZJCU01AE4HL.7.28.C06.1.454.heavy.3.raw

SEQ ID NO: 463726 - DNA, 549 bp, Homo sapiens
  misc_feature: HEFZJCU01EU9YA.18.78.H01.1.454.heavy.3.raw
tacgagtatgcacgaccggtgctcgatttagtgtgagtagtttgggtttggggctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgcaaatgaacagcctgaaaaccgaggacacggccgtgtattactgtactagacaggtggattacagtttggggggagtttatcgacggaaacgggggggtaacgtaccgtacgta

SEQ ID NO: 463727 - DNA, 521 bp, Homo sapiens
  misc_feature: HEFZJCU01CXBI8.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatggggcttgttctggggccaggggaccctggtcatcgtctccccagcctccaccaagggcccatcggtcttcccctggccg

SEQ ID NO: 463728 - DNA, 439 bp, Homo sapiens
  misc_feature: HEFZJCU01BHIMH.16.78.H01.1.454.heavy.3.raw
  modified_base (353)..(353): a, c, t, g, unknown or other
tgtactactccacgaccggtgctcgatttagtgtgagtagtttgggtttggggcatgaactgggtccgccagactccagggaaggggctggagtgggtcgcatccattagtggtggtaataattacatatactacggagactcaatgaagggccgcttcaccatctccagagacaacgccgaaaactcactgtatctgcagatgaacagcctgagagccgaagacacggctgtgtattactgtgcgagaggtcttactatagttcggggagttaatataacgacgtatttcgatctgtgggccgtggcaccctggtctctgtctcctcagcctccaccaagggcccatcggtnttccccctggcaccctcctccaagagcacctctgggggcacagcggccctgggctgcctggtcaaggactacttccgagtagtaca

SEQ ID NO: 463729 - DNA, 507 bp, Homo sapiens
  misc_feature: HEFZJCU01DRF61.12.30.C08.1.454.heavy.3.raw
  modified_base (475)..(475): a, c, t, g, unknown or other
atacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtggctccatcagcagtggtgattattactggagttggatccgccagtcccccagggaagggcctggagtggattgggtacatctatcacagtgggagcacctactacatcccgtccctgaagagtcgaattacgatgtcagtaacacgtctaggaaccagttctccctgaagctgaggtctgtgactgccgcagacacggccgtctactactgtgccaggtgggctttgcgccagtggttcagagangatcgcttcgattcgtggggccagggaattcg

SEQ ID NO: 463730 - DNA, 502 bp, Homo sapiens
  misc_feature: HEFZJCU01D6H0J.26.23.C01.1.454.heavy.3.raw
agactatactcacgaccggtgctcgatttagtacacgtgattagggattgggaggcgtggtccagcctgggggctccctgagactctcctgtacaacgtctggattcaacttcaattattatgttctacactgggtccgccaggctccaggcaaggggctggagtgggtggcaggtatgtcacatgatggattcagtagatactacatagactccgtgaagggccgatcgaccatctccagagacgtttccgagaacacattaaatctggaaataaacttcgtgagaagtgacgactcggccgtttattttgtgcgagagaggggtacagtagcggccgagctccggcctttgaccactggggccagggaaccctggtcaccgtctcctcagcctccaccaagggcccatcggtcttcccctggccgccctgctccaggagcacctccgagagcacagcggccctgggctgccctggtcaaggactacttccagtatagtct

SEQ ID NO: 463731 - DNA, 500 bp, Homo sapiens
  misc_feature: HEFZJCU01E2EGT.53.26.C04.1.454.heavy.3.raw
cgcgtatacacacgaccggtgctcgatttagtctagcgactttgggtttgggggagcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcagggcgagggtcgtccatgaccagggacagggccgatcagaacagcctacatggagctgaacagactgacatctgacgacacggccgtttattattgtgtgagagaggacccgacgtagaccgtcc

SEQ ID NO: 463732 - DNA, 490 bp, Homo sapiens
  misc_feature: HEFZJCU01B61TY.52.56.F01.1.454.heavy.3.raw
  modified_base (482)..(482): a, c, t, g, unknown or other
cgcagtacgacacgaccggtgctcgatttagcagacgtctgaacacacaaaggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaagtccctgagactctcttgtgcagcctctggattcaccttcagtagttatgttatgcaatgggtccgccaggctccaggcaaggggctggagtgggtggcacttatatcaggtgatggaggcaataaatattacacagactccgtgaagggccgattcaccatctccagagacaattccaagaacacgctgaatctgcaaatgaacagcctgagagttgaggacacggctgtctatttctgtgcgaganatcgtctt

SEQ ID NO: 463733 - DNA, 500 bp, Homo sapiens
  misc_feature: HEFZJCU01D8HTM.49.83.H06.1.454.heavy.3.raw
agtcgagagacacgaccggtgctcgatttagatcacgtgcgtcgcggggagtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcagcttctctgggttctcactctccagtcctggagtgggtgtgggctggatccgtcagcccccaggaaaggccctggagtggcttgcactcatttattggaatgacgataagacctacagcccatctctgaagagcaggctcaccatcaccaaggacacctccaacaaccaggtggtccttacaatgaccaacatggaccctgtggacacagccacatattactgtgcacacgtccccccgccgtacttattatgatgctagtggttattccaacgctgaatacttccagcactggggccagggcaccc

SEQ ID NO: 463734 - DNA, 519 bp, Homo sapiens
  misc_feature: HEFZJCU01C2K5T.26.71.G05.1.454.heavy.3.raw
agactatactcacgaccggtgctcgatttagtgtcgtcgcaagagagagggggggggaagaggaagactgacggtcctgcgctggtggagcccacgcagaccctcacgctgacctgctccgtctctggattctcactcaccacgactgaggtgaatgtggcctgggtccgtcaggcccccggaaaggccctggagtggcttgcactcatttactggagtgatctcaagcggtacaatccgtctctgaggaatcgactcaccatcaccagggacacctccaaagaccgggtggtccttacaatgaccgacatgaatcctgtggacacaggcacatattactgtgcacacagtcctagcggctacgcgagaaaagaatatgactattggggccagggaattttggtcaccgtctccccagcctccaccaagggcccatcggtcttcccctggcgccctgctccaggagcacctccgagagcacagcggccctcggggctgcctggtcaaggactacttcct

SEQ ID NO: 463735 - DNA, 514 bp, Homo sapiens
  misc_feature: HEFZJCU01ETATC.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaaggcccatcggtcttcccctggcaccctcctccaagagcacctctgggggcacagcggcctggctgcctggtcaggactactcctagagacacg

SEQ ID NO: 463736 - DNA, 465 bp, Homo sapiens
  misc_feature: HEFZJCU01DSA6Y.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacgggggaaaattggggccagggaaccctggtctccgtctcgtcagcctccaccaagggcccatcggtcttcccctggcgccctgctccaggacgcacctccgagagcacagccggccctgggctgcctggtcaaggactacttcccacgagagta

SEQ ID NO: 463737 - DNA, 491 bp, Homo sapiens
  misc_feature: HEFZJCU01C7KPP.48.59.F04.1.454.heavy.3.raw
agtatacatacacgaccggtgctcgatttagtacacacacttagggattggggacccaacaaccacatccctcctcagaagcccccagagcacaactccgtaccatggactggacctggaggatcctctttttggtggcagcagccacaggtgcccactcccaggtccagcttgtgcaatctgggactgaactgaagaagcccgggggctctgtgagggtttcatgcaaggcctctggatactcgttcacaacctacactatgcattgggtgcgccaggcccccggacaagccttgagtggatgggtggctcaacgctggcgatggtcagacaaagtattcacagaagttccagggcagagtcaccatcaccagggacacgtccgcgagtagtgtcttcatggagctgcgcagtctgagatcggaagacacggcagtatattactgtgcgagaggcggatatgtcgtcgaggtgactgctacagtcaaaat

SEQ ID NO: 463738 - DNA, 545 bp, Homo sapiens
  misc_feature: HEFZJCU01CBGMA.15.86.H09.1.454.heavy.3.raw
tctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaagtaaaaatgatggtgagaaaatagactacggtgcacccgtgaaaggaagattcaccatctcaagagataattcaaaaacgacggtgtatttgcaaatgaacagcctgaaaaccgaggacacagccgtctattaactgtaccacagattcggaagtgcatcgacgtaaaggaggctatgcttttgatatctggggcccagggacaat

SEQ ID NO: 463739 - DNA, 508 bp, Homo sapiens
  misc_feature: HEFZJCU01CUH2M.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactgggccagggactctggtcaccgtctccgcagcctccacaaggcc

SEQ ID NO: 463740 - DNA, 507 bp, Homo sapiens
  misc_feature: HEFZJCU01CAM0E.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaagtagacgtggtattccggggggacacatgactaccg

SEQ ID NO: 463741 - DNA, 517 bp, Homo sapiens; identical to SEQ ID NO: 444897
  misc_feature: HEFZJCU01EE2M7.9.34.D01.1.454.heavy.3.raw

SEQ ID NO: 463742 - DNA, 430 bp, Homo sapiens
  misc_feature: HEFZJCU01B5M9M.11.39.D06.1.454.heavy.3.raw
cgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgagggagtcctattacgcagctggctactacgttgacttctggggccaggggaccctggtcaccgtctcctcagcctccaccaagggcccatcggtcttccccctggcaccctcctccaagagcactctgggggcacagcggccctgggctgcctggtcaaggctacttccgtatctctcg

SEQ ID NO: 463743 - DNA, 485 bp, Homo sapiens; identical to SEQ ID NO: 444908
  misc_feature: HEFZJCU01D7ZMW.12.40.D07.1.454.heavy.3.raw

SEQ ID NO: 463744 - DNA, 512 bp, Homo sapiens
  misc_feature: HEFZJCU01DHUIN.21.34.D01.1.454.heavy.3.raw
tcgtcgctcgcacgaccggtgctcgatttagatcgtctgtgttgggtttgggggaggcttggtccagcctggggggtccctgagagtctcctgtgtggcctctggattcaagtttaatacctattggatgagctgggtccgccaggctccagggaaggggctggagtgggtggccaacataaaggaagatggaagtgacaaaaagtatgtggactctgtgaagggccgattcaccatcttcagagacaacgccaagaactcactttatctgcaaatgaatagcctgagagtcgaagacacggctgtgtattactgtgcgagagatagcgaggaggtggagcagctcgtcgatttgtactacatggacgtctggggcaaaggggaccacggtcaccgtctcctcagcctccaccaaggcccatcggtcttcccctggcaccctcctccaagagcacctctgggggcacgagcggcctgggctgcctggtcaggactacttcccgagccgacga

SEQ ID NO: 463745 - DNA, 477 bp, Homo sapiens
  misc_feature: HEFZJCU01DE047.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttcccctggcgccctgctccaggagcacctccgagagcacagcggccctgggctgcctgtcaggactattccagacgtatca

SEQ ID NO: 463746 - DNA, 508 bp, Homo sapiens
  misc_feature: HEFZJCU01B9N13.9.14.B03.1.454.heavy.3.raw
tgatacgtctcacgaccggtgctcgatttagtgtgagtagtttgggtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctgggctgcctggtcaggactacttccagacgtatca

SEQ ID NO: 463747 - DNA, 492 bp, Homo sapiens
  misc_feature: HEFZJCU01BM93J.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctggaggggccgattcaccatctccagagacaattcccagaacacggtctatctgcacctgaccagcctgagaactgacgacacgtctctctactactgtgcgagagagttgacgagt

SEQ ID NO: 463748 - DNA, 500 bp, Homo sapiens
  misc_feature: HEFZJCU01BTU3G.51.85.H08.1.454.heavy.3.raw
cgatcgtatacacgaccggtgctcgatttagtatcactcagtcgcggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggactctgggggaggcgtggtccagcctgggaggtccctgcgactctcctgtgcagcctctggattcagcttcagggctaatactatgttctgggtgcgccaggctccaggcaaggggctggagtgggtggcagtcatctggcctgatggaggtttaacatactatgcggactccgtggagggccgattcaccgtctccagagacaactaccaaaaacacgctgtatctccaaatgaacagcctcagatctgaggacacggctatctactactgtgtgaaagtaattgggtttcagtggtc

SEQ ID NO: 463749 - DNA, 500 bp, Homo sapiens
  misc_feature: HEFZJCU01D4G0O.11.71.G05.1.454.heavy.3.raw
  modified_base (479)..(479): a, c, t, g, unknown or other
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagntttactatagaggtgacgtac

SEQ ID NO: 463750 - DNA, 518 bp, Homo sapiens
  misc_feature: HEFZJCU01CC605.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattacgtggggccgggaaccctggtcgccgtctcctcagcctccaccaagggcccatcggtcttcccctggcaccctcctccaagagcacctcgtgggggcacagcggccctggctcgctggtcaaggactacttccagacgtatca

SEQ ID NO: 463751 - DNA, 484 bp, Homo sapiens
  misc_feature: HEFZJCU01ERXFR.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagacggccccataacg

SEQ ID NO: 463752 - DNA, 483 bp, Homo sapiens
  misc_feature: HEFZJCU01DW1QQ.47.59.F04.1.454.heavy.3.raw
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatacagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggcccatcggtcttccccctggcgccctgctccaggagcacctccgagagcacagcggccctgggctgcctggtcaaggactacttcctacgtgagct

SEQ ID NO: 463753 - DNA, 513 bp, Homo sapiens
  misc_feature: HEFZJCU01B8CXX.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctgggccaagggacactggtcaccgtctcttcagcctccaccaacgggcccagtcggtccttcccccgtggccgccctgcctccaggacg

SEQ ID NO: 463754 - DNA, 538 bp, Homo sapiens
  misc_feature: HEFZJCU01AMB97.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaaatgaacagcctgagaaccgaggacacaagccgtgtattactgttaccacatccctgaaagcgtcaactactactactacggtatggacctcgtggggaccg

SEQ ID NO: 463755 - DNA, 502 bp, Homo sapiens
  misc_feature: HEFZJCU01CD8PU.22.5.A05.1.454.heavy.3.raw
acatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcagcccccaggaaaggccctagactggcttgcactcatttattggaatgatgataagcgctacagcccatctctgaagagcagactcaacatcaccaaggacacctaccaaaagcaagtggtccttacaatgaccaacatggaccctttggacacagccaccatattactgtgcacaccacagggtctctactgctggctttcagtacaactggttcgaacccgtggggccagggaaccctggtcagtcgtctcctcagcct

SEQ ID NO: 463756 - DNA, 536 bp, Homo sapiens
  misc_feature: HEFZJCU01B14E9.13.88.H11.1.454.heavy.3.raw
tcacgtactacacgaccggtgctcgatttagcgacagcgagaacacacaaagggggggattcccaagtgttttcattcagtgatcaggactgaacacagaggactcaccatggagtttgggctgagctggattttccttggtgtttttttaaaaggtgtccactgtgagctgcagctggtggagtctggggggggcttggtaaagcctggggggtcccttacactctcctgtgtagcctctaaaatcactttcaacgacgcctggatgagctgggtccgccaggcgccagggaggggactggagtgggttggccgtattaaagcgaggccgatggtgggacagcagacttcgctgcacccgtgcaagccagattcaccctctcaagacatgatttagagaatactgtgtatttgcaaatgaacagcttgacaaccgaggacgcaggcgtttattactgtgccagtagttccacctggccactctacttctttgacttctggggccagggaaccctggtcgccgtctcctcacgctt

SEQ ID NO: 463757 - DNA, 516 bp, Homo sapiens
  misc_feature: HEFZJCU01BSDRK.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctcgcagtcgacactttgattactggggccgggaaccctggtcgccgtctcctcagcctccaccaagggcccatcggtcttcccctggcaccctcctccaagagcacctctgggggcacagcggccctgggctgcctggtcaaggactacttccagacgtatca

SEQ ID NO: 463758 - DNA, 560 bp, Homo sapiens
  misc_feature: HEFZJCU01D2TE1.16.87.H10.1.454.heavy.3.raw
  modified_base (533)..(533): a, c, t, g, unknown or other
tgtactactccacgaccggtgctcgatttagcagtactgcgttgggtttgggctgatctgggtcttccttgttgctttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtggaaacagttatgggttggggggagttggggtttttttttcgttacgttacgggatgggacgtcgtgggggccgaggggaccgcggtcaccgtctcctcagcctccaccaagggcccatccggtcttcccccnggccaccctcctccaagagcacctcgg

SEQ ID NO: 463759 - DNA, 532 bp, Homo sapiens
  misc_feature: HEFZJCU01D93G4.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttgggccagggaaccctggtcaccgtctcctcagcctccaccaaggcccatcggtcttcccctggcaccctcctccaagagcacctctcgggggcacagccggccctgggctgcctc

SEQ ID NO: 463760 - DNA, 503 bp, Homo sapiens
  misc_feature: HEFZJCU01BL8H7.21.35.D02.1.454.heavy.3.raw
tcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactccgtgaagggccgattcaccatctccagagacaattccaagaacacgctgtttctgcaaatgagcagcctgaaagaagaggacacggctgtatataactgtgcgcgaggaccttattattatggttcagggaccattgactactggggccagggaaccctggtcaccgtctcctcagcctccaccg

SEQ ID NO: 463761 - DNA, 503 bp, Homo sapiens
  misc_feature: HEFZJCU01AV5T9.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcgggactgacctcgtcgacgacacggccatgtattactgtggaagagacgttggtggctaccgcggggtctgaccactggggcc

SEQ ID NO: 463762 - DNA, 466 bp, Homo sapiens
  misc_feature: HEFZJCU01C8CG4.48.78.H01.1.454.heavy.3.raw
agtatacatacacgaccggtgctcgatttagtgtgagtagtttgggtttggggagctctgagagaggagccttaggcctcgattccaaggcctatccacttggtgatcagcactgagcaccgaggattcaccttggaactggggctccgctgggttttccttgttaatgttttagaaggtgtccagtgtgaggtgcagttggtggagtctgggggaggcctggtcaagtcgggggggtccctgagagtctcttgtgcagcctctagactcagtttcaatcaatgagacttggatttcctagtgtcactgcaatatggacgtctggggccaagggaccacggtcaccgtctcgtcagcttccaccaagggcccattcggtcttccccctggcgccctgctccaggagcacctctgggggcacagcggccctgggctgcctggtcaaggactacttcctatgtatact

SEQ ID NO: 463763 - DNA, 520 bp, Homo sapiens
  misc_feature: HEFZJCU01EUGVL.13.87.H10.1.454.heavy.3.raw
tcacgtactacacgaccggtgctcgatttagcagtactgcgttgggtttgggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgacaaatgaacagcctgagagctgaggacacggccttgtattattgtgacaaaagactaccaaccccttacgtatttttaggagtggtttaacg

SEQ ID NO: 463764 - DNA, 544 bp, Homo sapiens
  misc_feature: HEFZJCU01CF97F.16.39.D06.1.454.heavy.3.raw
tgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccagggaaggggctggaatgggtctcagttattgaaaatgatggtgacacaatctacgccgactccgtgaagggccgattcaccatctccagagacaattccaagaacacggtgaatcttcaaatgaacagcctgagaaccgaggacacggccgtatattattgtataggttatggtggtaattcgggcccctggggccagggaaccgtggtcaccgtctcctcagcctccaaccg

SEQ ID NO: 463765 - DNA, 497 bp, Homo sapiens
  misc_feature: HEFZJCU01BKBKQ.11.71.G05.1.454.heavy.3.raw
  modified_base (359)..(359): a, c, t, g, unknown or other
  modified_base (478)..(478): a, c, t, g, unknown or other
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttattcatatgatggaaatagtgacttntattcagactccgtgaagggccgattcaccgtctccagagacaattccaggcacacgctgtatctgcaaatgaacagcctgagagctgaggacacggctgtgtattactgtgcgaaagntttcatagaggtgacgtac

SEQ ID NO: 463766 - DNA, 510 bp, Homo sapiens
  misc_feature: HEFZJCU01DGGEJ.49.81.H04.1.454.heavy.3.raw
agtcgagagacacgaccggtgctcgatttagtagtgtagattcgcgggagctctgggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctgggttcaccttcagggtctatgacatgcactgggtccgccaggctccaggcgaggggctggagtgggtggcagttatatcgaatgatggaagtaagaagtactatgcagactccgtgaagggccgattcaccatctccagagacaattccaagaacacgctatatttgcacatgaacagcctgagagctgaggacacggctatttattactgtgcgaacttaatcacggagacaagggtcgacccccgtcc

SEQ ID NO: 463767 - DNA, 511 bp, Homo sapiens
  misc_feature: HEFZJCU01BERAQ.10.38.D05.1.454.heavy.3.raw
catagtagtgcacgaccggtgctcgatttagtatctgatagttggggtttggggggagaggagcccagcactgggattccgaggtgtttccattcggtgatcagcactgaacacagaggactcaccatggagttttggctgagctgggttttccttgttgctatttcaaaaggtgtccactttgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggtttacaccctctccagagacacttccaacaacatcttgtatcttcacatgcacaatctgagagtcgacgacacggccacctattattgtgcgcgacatgactacgctcaattctggggccagggagcccg

SEQ ID NO: 463768 - DNA, 525 bp, Homo sapiens
  misc_feature: HEFZJCU01A64JR.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgtggtttccgttgttaggctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaaagccaagaactcactgactttgcaaatgaacaccctgcgagccgaggacacggccgtatattactgtgcgagaaataacccgttcgcctggttatttaccg

SEQ ID NO: 463769 - DNA, 488 bp, Homo sapiens
  misc_feature: HEFZJCU01EH93E.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgtgaggattgcagtggagagtccttactactactactactacatggacgtctggggcaaagggaccacggtcaccgtctcctcggcctccaccaagggcccatcggtcttcccctggcgccctgctccaggagcacctccgagagcacagcggccctgggctgcctggtcaaggactacttccatactcgta

SEQ ID NO: 463770 - DNA, 492 bp, Homo sapiens
  misc_feature: HEFZJCU01ELPBL.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtccaccgtctcctcagcctccaccaagggcccatcggtcttcccctcggcgccctgctccaggagcacctccgagagcacagcgccctgggctgcctggtcaaggactacttcccacgagagta

SEQ ID NO: 463771 - DNA, 509 bp, Homo sapiens
  misc_feature: HEFZJCU01D292L.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctggggccagggaaccctggtcaccgtctcctcagcctccaccaagggcccatcggtcttcccctggcaccctcctccaagagcacctctgggggcacagcggccctgggctgcctggtcaaggactactccgtacta

SEQ ID NO: 463772 - DNA, 527 bp, Homo sapiens
  misc_feature: HEFZJCU01ESXNO.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcaggcggcgtatctgcagatcaccagccttcaggctgaggacactgccatttattactgtgcgagagagggggagagtggagtagaacgtaaatacgggaaccgtttgacttttggggccagggaaccctggtcaccgtctcctcagcctccaccaaggcccatcggtcttcccctggcaccctcctccagagcacctctgggggcacagcggccctgggctgcct

SEQ ID NO: 463773 - DNA, 484 bp, Homo sapiens
  misc_feature: HEFZJCU01C6ID0.51.76.G10.1.454.heavy.3.raw
  modified_base (420)..(420): a, c, t, g, unknown or other
  modified_base (455)..(455): a, c, t, g, unknown or other
cgatcgtatacacgaccggtgctcgatttagtcactcatacaggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcccgggaggtccctgagactctcctgtgcagcctctggattcaccttcagtgcctatggcatgcactgggtccgccaggctccaggcaaggggctggagtgggtggcatttatatcagatgatggcagtaataaagagtatgcagtctccgtgaagggccgattcaccatctccagagacaattccccagaaccacacngtatctgcaaatgaacagattgagagctgaggacncggctgtgtatttctgttgcgaaacgctt

SEQ ID NO: 463774 - DNA, 504 bp, Homo sapiens
  misc_feature: HEFZJCU01C0VP1.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtgggcttgcactcatttattgggatgatgataagcgctacagcccatctctgatgaacaggctcaccatcaccaaggacgcctccaaaaaccaggtggtccttacaatgaccaacatggaccctgtggacacagccacatattactgtgcacagagatacggggcagcacggtggtttggggctacgtggggccagggaaccctgggtccaccggtctcctcagcctccaaccg

SEQ ID NO: 463775 - DNA, 517 bp, Homo sapiens
  misc_feature: HEFZJCU01CW1YS.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagccggccctcgggctcg

SEQ ID NO: 463776 - DNA, 476 bp, Homo sapiens
  misc_feature: HEFZJCU01BRCL2.40.37.D04.1.454.heavy.3.raw
tctagcgactcacgaccggtgctcgatttagtagcatactgttgggtttggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcaggaagtgggagctggtaggcctcaatactggggccggggaatcctggtcaccgtctcctcagcctccaccaagggcccatcggtcttccccctggcgccctgctccaggagcacctccgagagcacagcggccctgggctgcctggtcaaggactacttccagtcgctag

SEQ ID NO: 463777 - DNA, 489 bp, Homo sapiens
  misc_feature: HEFZJCU01EE93M.10.21.B10.1.454.heavy.3.raw
catagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatccta

SEQ ID NO: 463778 - DNA, 399 bp, Homo sapiens; identical to SEQ ID NO: 451078
  misc_feature: HEFZJCU01BSFEN.47.24.C02.1.454.heavy.3.raw

SEQ ID NO: 463779 - DNA, 484 bp, Homo sapiens; identical to SEQ ID NO: 446564
  misc_feature: HEFZJCU01AKXUS.19.13.B02.1.454.heavy.3.raw

SEQ ID NO: 463780 - DNA, 511 bp, Homo sapiens
  misc_feature: HEFZJCU01D3MKY.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgttgttttggccggtgaactactggggccagggcaccctggtcaccgtctcctcagcttccaccaagggcccatcggtcttcccctgcgccctgctccaggagcacctctgggggcacgagcggccctgggctgcctggtcaaggactacttcccatac

SEQ ID NO: 463781 - DNA, 521 bp, Homo sapiens
  misc_feature: HEFZJCU01EZOCW.14.57.F02.1.454.heavy.3.raw
cgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtattttgtgttgaaagatacgaagtctatgatacccaatttgggaggggcctttcat

SEQ ID NO: 463782 - DNA, 478 bp, Homo sapiens; identical to SEQ ID NO: 448105
  misc_feature: HEFZJCU01CAM06.26.78.H01.1.454.heavy.3.raw

SEQ ID NO: 463783 - DNA, 375 bp, Homo sapiens
  misc_feature: HEFZJCU01BCEPL.13.78.H01.1.454.heavy.3.raw
tcacgtactacacgaccggtgctcgatttagtgtgagtagtttgggtttggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcgcggggcacttttgatatctggggccaagggtcgatggtcatcgtctcttcagcctccaccaagggcccatcggtcttccccctggcgccctgttccaggagcacctccgagagcacagcggccctgggctgcctggtcaaggactacttccgtactagacg

SEQ ID NO: 463784 - DNA, 540 bp, Homo sapiens
  misc_feature: HEFZJCU01DPVL3.52.73.G07.1.454.heavy.3.raw
cgcagtacgacacgaccggtgctcgatttagctctacgctcagggggtgctttccgagagtcatggacctcctgcacaagaacatgaaacacctgtggttcttcctcctcctggtggcagctcccagatgggtcctgtcccaggtgcacctacaacagtggggcgcaggactgttgaagccttcggagaccctgtccctcacctgcgctgtcgatggtgggtccttcagtggtcgctactggacctggatccgccagcccccagggaaggggctggagtggattggggaaatcaatcatactggaagcattaactataacccgtcccttaagagtcgagtcaccatatcagtcgacacgtccaagaaccaattctccctgaaggtgaggtctgttaccgccgcggacacggctgtctattactgtgcgaaaggccctcacgatgaaaactacgccctcggcgctatggacgtctggggccaagggaccacggtcaccgtctcctcagcctccaccaagggcccatcggtcttcccctcgg

SEQ ID NO: 463785 - DNA, 537 bp, Homo sapiens
  misc_feature: HEFZJCU01C25BB.18.59.F04.1.454.heavy.3.raw
tacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaactgatggtgggacaacagactacgctgcacccgtgaaaggcagattcaccatctcaagagatgattacaaaagcacgctgtatctgcaaatgaacagcctgacgaacgaggacacagccgtgtattactgtaccacactcccgtgaaacgcgtacaactactaacctactacgtatcggacctcgtcgggg

SEQ ID NO: 463786 - DNA, 475 bp, Homo sapiens
  misc_feature: HEFZJCU01BN5IR.3.39.D06.1.454.heavy.3.raw
agacgcactccacgaccggtgctcgatttagtgacatctcgcagttctttgggttttggggggtccctgagactctcatgtacaggctctgagttcagcgtcactaaatactacatgagctgggtccgccaggctccagggaggggactggactgggtctccagtgttaacagcgatggaagtacatattatgcagactccgtgaagggccgattcaccatctccagagacaattccaagaacactctgtatcttcaaatgaacagcctgagagccgaggacacggccttctattactgtgcgagcgatcacgggcggagtctgatactttcttggggccagggaaccctggtcaccgtctcctcagcctccaccaagggcccatcggtcttcccctggcgccctgctccaggagcacctccgagagcacagccggccctgggctgcctggtcaagactacttccgagtgcgtct

SEQ ID NO: 463787 - DNA, 443 bp, Homo sapiens; identical to SEQ ID NO: 446583
  misc_feature: HEFZJCU01DISEO.10.11.A11.1.454.heavy.3.raw

SEQ ID NO: 463788 - DNA, 396 bp, Homo sapiens; identical to SEQ ID NO: 444469
  misc_feature: HEFZJCU01AZH8M.47.46.E02.1.454.heavy.3.raw

SEQ ID NO: 463789 - DNA, 520 bp, Homo sapiens
  misc_feature: HEFZJCU01DX88L.16.38.D05.1.454.heavy.3.raw
tgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtctgggggaggcgtggtccagcctggaaggtccctgagactctcgtgtgcagcgtctggattcattctttaatagttttcctatgcactggatccgccaggctccaggcaggggactggagtgggtggcaggagtgtcacttgatggagccaatacatacttcgcagactccgtgaagggccgattcaccatttccagagagaattccaacaacacgctgcatctgcaaatggacaccctgacgacctgacgacacggctgtctattactgtgtgagactcttattgcgttcgggctttgactcgtgggccgagggactccctggtcaccgtctcctcagcctccaccaagggccagtcggtccttcccctcg

SEQ ID NO: 463790 - DNA, 487 bp, Homo sapiens
  misc_feature: HEFZJCU01D2XUF.47.85.H08.1.454.heavy.3.raw
agctcacgtacacgaccggtgctcgatttagtatcactcagtcggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaacgggcccatcggtcttcccctggcgcctgctccaggagcacctccgagagcacagcggccctgggctgcctggtcaaggactacttcctacgtgagct

SEQ ID NO: 463791 - DNA, 393 bp, Homo sapiens
  misc_feature: HEFZJCU01B4KZE.16.24.C02.1.454.heavy.3.raw
tgtactactccacgaccggtgctcgatttagtacagatcgttagggaaggggctggagtgggtctcaagtattagtggtgttggtggtctcacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 463792 - DNA, 481 bp, Homo sapiens
  misc_feature: HEFZJCU01CV0IH.13.86.H09.1.454.heavy.3.raw
tcacgtactacacgaccggtgctcgatttagtgctatagacttgggtttggggcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacagactatggacagaacctccagggcagattcaccatgacgacagacacatacacgaacacagcctacatggaggtgaggagcctgagatatgacgacacggccgtgtattattgtgcgagagtggagtggcagtggatatcgacaaattactactattacatggacgtcgtgggg

SEQ ID NO: 463793 - DNA, 498 bp, Homo sapiens
  misc_feature: HEFZJCU01EDIOW.51.71.G05.1.454.heavy.3.raw
cgatcgtatacacgaccggtgctcgatttagtgtcgtcgcaagagagagggggagctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctagtgttttactgtgcgagaagggaactcgaatt

SEQ ID NO: 463794 - DNA, 384 bp, Homo sapiens
  misc_feature: HEFZJCU01CT7H0.18.60.F05.1.454.heavy.3.raw
tacgagtatgcacgaccggtgctcgatttagtacgtcatcagggaaaggggctggaatatattgggattacctcttacagtgggaccacccattacaacccgtccctcaaaagtcgactcaccatttccgtggacacgtcgaaaacgagttctccctggacttgacctctgtgaccgccgcagacacggctgtttattactgtgcgagacgactacctgactccaatccatactttgactattggggccgggagccctggtcaccgtctccccaccctccaccaagggcccatcggtcttccccctggcaccctcctccaagagcacctctgggggcacagcggccctgggctgcctggtcaaggactacttcccatactcgta

SEQ ID NO: 463795 - DNA, 500 bp, Homo sapiens
  misc_feature: HEFZJCU01EP633.53.14.B03.1.454.heavy.3.raw
cgcgtatacacacgaccggtgctcgatttagtgtgagtagttccgcgggcctggcgcacccaatggatagcatgggtactgagggtgtatccagaagcctggcaggaaaccttcactgaggccccaggcttcttcgcctcagccccagactgcacaagctggacctgggagtgggcacctgtggctgctgccaccaaaagaggatcctccaggtccagtccatggtgaggcgttgtgctctgggggcttctgaggagggatgtggttgttgggtcagcgctggcaatggtgacagacactattcacagaagttccagggcagagtcaccatcaccagggacacatccgcgagcacagcctacatggaactgagcagcctgagatctgaagacacgggtgtatattactgtgcgagagggaagtgggatattgtagatgcgccaggtgcccggccggccccctactttgactactggggccggggaaccctggtcaccggt

SEQ ID NO: 463796 - DNA, 534 bp, Homo sapiens
  misc_feature: HEFZJCU01C4KOM.49.7.A07.1.454.heavy.3.raw
agtcgagagacacgaccggtgctcgatttagcacgtgtcgcaagagagaggggggagtctccttcaccacccagcggggatctcacggcttccttttctgtcctcctccaggatggggtcaaccgccatcctcgccctcctcctggctgttctccaaggagtctgtgccgaagtgcagctggtgcagcccggagcggtaatgaaaagcccggggagtctctgaggatctcctgtaagggttctggatacagctttagtaccttctggatcacctgggtgcgccagctgcccgggaaaggcctggaatggatggggaggattgaccccagtgactccagtaccaactacagtccgtccttcgaaggccacgtcagcatctcacttgacgtgtccaccaccactgtctacctacagtggcgcagcctcaagacatcggacaccgccacctattacctgtgcacgacgccgttatacccagaggcgtggtaccttgacctcctggggccagggcaccgtggtccaccgtcctcctcg

SEQ ID NO: 463797 - DNA, 534 bp, Homo sapiens
  misc_feature: HEFZJCU01EU94F.53.68.G02.1.454.heavy.3.raw
cgcgtatacacacgaccggtgctcgatttagtcgatagtgaagggaaaggggcacaagaacatgaaacacctgtggttcttcctcctcctggtggcagctcccagatgggtcctgtcccaggtgcagctgcagcagtggggctcaggactgttgaagccttcggagaccctgtccctcacgtgcgctgtctatggtgggtcattcagtgattattattggacctggatccgccaggccccagggaaggggctggagtggatagcggaaatcaatcatagtggaaagactacctacaacccgtccctcaagagtcgagtcaccttatcggtagacacgcccaagaagcagttctccctgagggtgacgtctgtgaccgccgcggacacggctgtctattactgtgcgagaggccccttagtttcggtttttggactggttctcccatggaatccctactttgagtactggggccgcggagccctggtcaccgtctcctcagcctccaccaagggcccatcggtcttcccctggcc

SEQ ID NO: 463798 - DNA, 509 bp, Homo sapiens
  misc_feature: HEFZJCU01BBJMB.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaagggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggcca

SEQ ID NO: 463799 - DNA, 530 bp, Homo sapiens; identical to SEQ ID NO: 452392
  misc_feature: HEFZJCU01AZEYH.13.10.A10.1.454.heavy.3.raw

SEQ ID NO: 463800 - DNA, 371 bp, Homo sapiens
  misc_feature: HEFZJCU01CGY1D.3.42.D09.1.454.heavy.3.raw
agacgcactccacgaccggtgctcgatttagacacatacgcagggaaggggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacgggccgtgtaacgttggactactggggccagggaaccgtggtcaccgtctcctcagcctccaccaagggcccatcggtcttccccctggcaccctcctccaagagcacctctgggggcacagcggccctggactgcctggtcaaggactacttccgagtgcgtct

SEQ ID NO: 463801 - DNA, 512 bp, Homo sapiens
  misc_feature: HEFZJCU01BW0VY.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcgggagttattagtcccttactttgactactggggccagggaactctggtcaccgtctccgcagcctccaccagggccc

SEQ ID NO: 463802 - DNA, 385 bp, Homo sapiens; identical to SEQ ID NO: 444438
  misc_feature: HEFZJCU01ERA1V.18.60.F05.1.454.heavy.3.raw

SEQ ID NO: 463803 - DNA, 475 bp, Homo sapiens; identical to SEQ ID NO: 457107
  misc_feature: HEFZJCU01DW363.10.38.D05.1.454.heavy.3.raw

SEQ ID NO: 463804 - DNA, 499 bp, Homo sapiens
  misc_feature: HEFZJCU01DAWGU.11.71.G05.1.454.heavy.3.raw
cgagagataccacgaccggtgctcgatttagtgtcgtcgcaagagagagggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagatttctatagaggtgactac

SEQ ID NO: 463805 - DNA, 397 bp, Homo sapiens; identical to SEQ ID NO: 444534
  misc_feature: HEFZJCU01DJFLA.18.1.A01.1.454.heavy.3.raw

SEQ ID NO: 463806 - DNA, 505 bp, Homo sapiens
  misc_feature: HEFZJCU01CJR65.49.55.E11.1.454.heavy.3.raw
  modified_base (376)..(376): a, c, t, g, unknown or other
agtcgagagacacgaccggtgctcgatttagcactcgcacgttgggtttggggagctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccggggaaggtctggagtgggtctctcttattaattgggatggtggtatcacctactatgcagactcngtgaagggtcgattcaccatctccagagacaacagcagaaactccctgtatctgcaaatgaacagtctcagaggtgaggacaccgccttctactactgtgcaaaagattacggtgaccacacctatttt

SEQ ID NO: 463807 - DNA, 478 bp, Homo sapiens; identical to SEQ ID NO: 448105
  misc_feature: HEFZJCU01BU69E.26.78.H01.1.454.heavy.3.raw

SEQ ID NO: 463808 - DNA, 525 bp, Homo sapiens
  misc_feature: HEFZJCU01DN1W0.16.27.C05.1.454.heavy.3.raw
  modified_base (484)..(484): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtgcgtttatttcatatgatggaactactcaacactatccagactccggggagggccgattcaccgtctccagagacaattccaagaacagggtgtttctccaagtgattgatctgagaagtgagacacggctgtttatactgtgcgcggtggctgaccgntcttgactacgtggggtccggggagccccggtcatccgtct

SEQ ID NO: 463809 - DNA, 518 bp, Homo sapiens
  misc_feature: HEFZJCU01C0PFC.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagcgacgacacggccgtttattactgtgcgagagattcgagtggttcggggacctcacctggtctacttcgatctctgggcc

SEQ ID NO: 463810 - DNA, 511 bp, Homo sapiens
  misc_feature: HEFZJCU01EPV40.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatgggtggatcaacgtacagactggtggcacagactatgcacaggggctccagggcagactcaccatgaccacagacacatcagcgaacacagtcaacatggagttgcggagcctgcgatctgacgacgcggccgtatattactgtgcgagagtacgtagcggctcgtcttgactactggggcctgggactctggtcaccgtctcc

SEQ ID NO: 463811 - DNA, 490 bp, Homo sapiens
  misc_feature: HEFZJCU01B2H0M.49.82.H05.1.454.heavy.3.raw
agtcgagagacacgaccggtgctcgatttagtcgagctctctcgcggggagctctcagagaggtgccttagccctggattccaaggcatttccacttggtgatcagcactgaacacagaggactcaccatggaattggggctgtgctgggttttccttgttgctattttagaaggtgtccactgtgacgtgcagctggtggagtctgggggagccttggttcagcctggagggtccctgagactctcctgtgcagcctctggattcagcttcagtagttatgagatgaactgggtccgccaggctccagggaagggactggagtgggtttcatacattagtcggagagtcaacaccgtattctacacagactctgtgaggggccggattcaccatctccagagacaacgccaagaactcactgtatctccaaatgaacagcctgagagtcgaggacacggctgtctattactgtgcgagagatacccaac

SEQ ID NO: 463812 - DNA, 396 bp, Homo sapiens; identical to SEQ ID NO: 444568
  misc_feature: HEFZJCU01D0GWY.47.46.E02.1.454.heavy.3.raw

SEQ ID NO: 463813 - DNA, 534 bp, Homo sapiens
  misc_feature: HEFZJCU01COJ1J.52.14.B03.1.454.heavy.3.raw
cgcagtacgacacgaccggtgctcgatttagtgtgagtagttccgcggggctttctgagagtcatggacctcctgtgcaagaacatgaagcacctgtggttcgtcctcctgctggtggcggctcccagatgggtcctgtcccagctgcaactgcaggagtcgggcccaggactggtgaagccttcggagaccctgtccctcacctgcactgtctctggtggctccatcagcagtagtgattactactggggctggatccgccagcccccagggaaggggctggagtggattgggagtgtcttttatagtggaaacacctactacaacccgtccctcaagagtcgagtcaccatatcagtagacacgtccaagagccagttctccctgaagctgacgtctctgaacgccgcggacacggccgtttattactgtgcgagtaccccggaaccttttacgatttttggagtggatactataccggtatggggccttttgacttctggggccagggaaccctggtcaccgtctcctcag

SEQ ID NO: 463814 - DNA, 515 bp, Homo sapiens
  misc_feature: HEFZJCU01DZ0KR.10.85.H08.1.454.heavy.3.raw
  modified_base (505)..(505): a, c, t, g, unknown or other
catagtagtgcacgaccggtgctcgatttagtatcactcagtcgcggggaggtctcagagaggagccttagccctggactccaaggcctctccacttggtgatcagcactgagcacagaggactcaccatggaattggggctgagctgggttttccttgttgttattttagaaggtgtccaatgtgaggagcagctggtggagtctggggaggcctggtccagccggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctggtatatttctgtgcgagggggagccgggctatggttcggacctcnggggtccaac

SEQ ID NO: 463815 - DNA, 510 bp, Homo sapiens
  misc_feature: HEFZJCU01EUA7F.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggccatcggtcttcccctggcgcctgctcaggagcacctctgggggcacagcggccctgggctgcctggtcaaggactacttcccatacc

SEQ ID NO: 463816 - DNA, 379 bp, Homo sapiens; identical to SEQ ID NO: 444450
  misc_feature: HEFZJCU01BKW4M.47.77.G11.1.454.heavy.3.raw

SEQ ID NO: 463817 - DNA, 484 bp, Homo sapiens; identical to SEQ ID NO: 448254
  misc_feature: HEFZJCU01C4487.12.75.G09.1.454.heavy.3.raw

SEQ ID NO: 463818 - DNA, 498 bp, Homo sapiens
  misc_feature: HEFZJCU01EDWDQ.40.81.H04.1.454.heavy.3.raw
tctagcgactcacgaccggtgctcgatttagtagtgtagattcgcgggggtgtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggtcg

SEQ ID NO: 463819 - DNA, 503 bp, Homo sapiens; identical to SEQ ID NO: 446295
  misc_feature: HEFZJCU01EKFF1.10.35.D02.1.454.heavy.3.raw

SEQ ID NO: 463820 - DNA, 512 bp, Homo sapiens
  misc_feature: HEFZJCU01CN5HZ.17.33.C11.1.454.heavy.3.raw
  modified_base (483)..(483): a, c, t, g, unknown or other
  modified_base (488)..(488): a, c, t, g, unknown or other
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcaacgctctatggttcgggagttattagtcctactttgactactgggccagggaactctggtcnccgtntccgcagcctcaccaaggcccatc

SEQ ID NO: 463821 - DNA, 508 bp, Homo sapiens; identical to SEQ ID NO: 444619
  misc_feature: HEFZJCU01BWPL7.3.81.H04.1.454.heavy.3.raw

SEQ ID NO: 463822 - DNA, 518 bp, Homo sapiens; identical to SEQ ID NO: 448934
  misc_feature: HEFZJCU01AT8CX.7.78.H01.1.454.heavy.3.raw

SEQ ID NO: 463823 - DNA, 510 bp, Homo sapiens; identical to SEQ ID NO: 459783
  misc_feature: HEFZJCU01B12AN.12.1.A01.1.454.heavy.3.raw

SEQ ID NO: 463824 - DNA, 531 bp, Homo sapiens
  misc_feature: HEFZJCU01EAZKW.16.27.C05.1.454.heavy.3.raw
  modified_base (473)..(473): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcggtgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgttctccaagtgattgatctgagaagtgaggacacggctgtttattactgtgcgnggtggctgaccgctcttgactacgtgggggcccggggagcccccgggtacatcgtcct

SEQ ID NO: 463825 - DNA, 503 bp, Homo sapiens; identical to SEQ ID NO: 445995
  misc_feature: HEFZJCU01ADD5B.17.25.C03.1.454.heavy.3.raw

SEQ ID NO: 463826 - DNA, 498 bp, Homo sapiens
  misc_feature: HEFZJCU01D16IT.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctggggtccgccaggctccagggaagggcctggagtggatctcacttatttatagtggcggcactacatactacacagacttcgcgaggggccgattcaccatctccagagacgattccaagaacacgttgtatcttcaaatgaacagcctgacagtcgacgacacggccatgtatttttgtgtcgagcgacccggggctcctcaatggctttc

SEQ ID NO: 463827 - DNA, 544 bp, Homo sapiens
  misc_feature: HEFZJCU01BOGYV.16.39.D06.1.454.heavy.3.raw
tgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccagggaaggggctggaatgggtctcagttattgaaaatgatggtgacacaatctacgccgactccgtgaagggccgattcaccatctccagagacaattccaagaacacggtgaatcttcaatgaacagcctgagaaccgaggacacggccgtatattattgtataggttatggtggtaaattcgggcccctgggggccagggaaccgtggtcaccgtctcctcagcctccaccg

SEQ ID NO: 463828 - DNA, 497 bp, Homo sapiens; identical to SEQ ID NO: 444995
  misc_feature: HEFZJCU01EAD2X.4.26.C04.1.454.heavy.3.raw

SEQ ID NO: 463829 - DNA, 395 bp, Homo sapiens; identical to SEQ ID NO: 445578
  misc_feature: HEFZJCU01CM39Q.14.79.H02.1.454.heavy.3.raw

SEQ ID NO: 463830 - DNA, 518 bp, Homo sapiens
  misc_feature: HEFZJCU01A74MF.22.34.D01.1.454.heavy.3.raw
acatacgcgtcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggccctgggctgcctggtcaaggactacttccagacgtatca

SEQ ID NO: 463831 - DNA, 497 bp, Homo sapiens
  misc_feature: HEFZJCU01B8Y4P.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctgggaatggggtggcagatatacaatatgatgacagtaaaatatactatggagactccttcaagggccgattcaccatctccagagacaattccaagaacataggtgtatctgcaaatgaccagcctgagagccgaggacacgggtgttattactgtgggagaaatcctagtggc

SEQ ID NO: 463832 - DNA, 527 bp, Homo sapiens
  misc_feature: HEFZJCU01C3I7N.48.2.A02.1.454.heavy.3.raw
agtatacatacacgaccggtgctcgatttagactcatctacagggggagtctccctcactgcccagctgggatctcagggcttcattttctgtcctccaccatcatggggtcaaccgccatcctcgccctcctcctggctgttctccaaggagtctgcgcggaagtgcgcctggtgcagtctggagcagtggtgaagaggcccgggggagtctctaaagatctcctgtcagggttctgaaggcgactttgacaccttctgggtcgcctgggtgcgccagaggcccggtaaaggactagagtatatgggcgtcatctatcctggtgactccgataccatatatactccgtcgtttcaaggccaggtcaccatgtctgccgacaagtccaagactgtcgcctacctccactgggccaactgacgtcctccgacagcgccacttattactgtgcgagggtaggcactacgtcttggggtcgaggaggacaactggttcgaccccgtggggcccaggggaaccctggtcca

SEQ ID NO: 463833 - DNA, 533 bp, Homo sapiens
  misc_feature: HEFZJCU01E0L4C.48.87.H10.1.454.heavy.3.raw
agtatacatacacgaccggtgctcgatttagcagtactgcgttgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaactgctttgtctctggaacttctatcaagggtagcagcttctacgtggggctggatccgccagcccccaggaaaggggctacaatgggttggaaatgtcaattcttatgggcgctcccactacaatccggccctccagagtcgagccctcatatccatagacacgtccaacaaccagttttccctgacgctgacgtctgtgaccgccgcagacacggctgtctattattgtgcgagactaggcttctgtagtggtggtacttgcaacccgggatactactccaacttcggcttggacatctggggccaagggacctcggtcgtcccg

SEQ ID NO: 463834 - DNA, 508 bp, Homo sapiens
  misc_feature: HEFZJCU01BQ3UY.11.6.A06.1.454.heavy.3.raw
cgagagataccacgaccggtgctcgatttagatctactgacagggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtctgggggaggcttggtaaagccgggggggtcccttagactctcctgtgcagcctctggcatcactttcagtgacgcctggatgagctgggtccgccaggctccagggaaggggctggagtgggttggccgtattaaaagcgaggctgctggtgggacaacagactacgctgcacccgtgaagggcagattcaccatctccagagatgattcaaggagcacagtgtttctacaaatgaacagcctgactgccgggggacactgccgtgtattactgtgccagcagcagcacctggccactatatttcttttcg

SEQ ID NO: 463835 - DNA, 524 bp, Homo sapiens
  misc_feature: HEFZJCU01CE7TJ.51.68.G02.1.454.heavy.3.raw
cgatcgtatacacgaccggtgctcgatttagtcgatagtgaagggaaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcactgtctctggtggctccatcagcagcagtagttacttctggggctggatccgccagcccccagggaagggactggagtggatagggaatgtccattatagtgggagcacctactacaatccgtccctcaacagtcgagtcaccatatccgttgacacgtccaagaaccaattcttcctgaggctgacctctgtgaccgccgcagatacggcagtttattactgtgcaagaaagaactacctgaaaactggggccacggaaccctggtcaccgtctcctcagcctccaccaagggcccatcggtctttcccccg

SEQ ID NO: 463836 - DNA, 482 bp, Homo sapiens
  misc_feature: HEFZJCU01CV5A8.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtggaagggactgctggggccagggagcccttgtcaccgtctcctcagcctccaccaagggcccatcggtcttcccctggcgccctgcccaggacgcacctccgagagcacagcggccctgggctgcctggtcaaggactacttcccactactatg

SEQ ID NO: 463837 - DNA, 536 bp, Homo sapiens
  misc_feature: HEFZJCU01B7ZSY.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtgggggcatttacttgaccccttgggggcccggggaacccgtggtcaccgtctccccaccctccaacccg

SEQ ID NO: 463838 - DNA, 483 bp, Homo sapiens; identical to SEQ ID NO: 447485
  misc_feature: HEFZJCU01BS0O6.40.71.G05.1.454.heavy.3.raw

SEQ ID NO: 463839 - DNA, 530 bp, Homo sapiens
  misc_feature: HEFZJCU01EZ8HG.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggccagggaaccctggtgaccgtctcctcagcctccaccaagggcccatcggtcttcccctggccgccctgctccaggagccgacctcccgagacggcacaggccggccccgt

SEQ ID NO: 463840 - DNA, 494 bp, Homo sapiens
  misc_feature: HEFZJCU01C9L1R.40.37.D04.1.454.heavy.3.raw
tctagcgactcacgaccggtgctcgatttagtagcatactgttgggtttgggggaggcttggtacagcctggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcaggaagtgggagctggtaggcctcaatactggggccgggaatcctggtcaccgtctcctcagcctccaccaagggcccatcggtcttcccctggcgccctgctcaggagcacctccgagagcacagcggcctgggctgcctggtcaaggactacttccagtcgctaga

SEQ ID NO: 463841 - DNA, 487 bp, Homo sapiens
  misc_feature: HEFZJCU01DLCSZ.4.87.H10.1.454.heavy.3.raw
  modified_base (482)..(482): a, c, t, g, unknown or other
agcactgtagcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaagtgaggaagcctggggcctcagtgaaggtctcctgcaagacttctggatacaccttcgccggctactatatgcactggattcgacaggcccctggacaagggcttgagtggatggggtggatcaacccttacagtggtgtcacaaactatgcacagaagtttcagggctgggtcaccgtgaccagggacacgtccgtcagcacagtttacatggaactgaggaaactgagatctgacgacacggccgtctactactgtgcggagagggtacacggtttanaccat

SEQ ID NO: 463842 - DNA, 455 bp, Homo sapiens
  misc_feature: HEFZJCU01B9AFE.48.71.G05.1.454.heavy.3.raw
agtatacatacacgaccggtgctcgatttagtgtcgtcgcaagagagaggggcaagggcgccagatggtccttcctcgtgagtcccaggaccaccctcggcctctggggtccagagtccaacaacccccgggccctccccggcctcaacctgagagagattcccagggacgttttccctggggtcctgacattgttgtcacaatgtgacaactgagtcgacccctggggccagagaaccctggtcaccgtctcctcagggtgaggatggacattccgccactgtgatcacttccactactgcggtatggacgtctgggccaagggaccacggtcaccgtctcctcagcttccaccaagggcccatcggtcttcccctggcgccctgctccaggagcacctctgggggcacagcggccctgggctgcctggtcaaggactacttcctatgtatact

SEQ ID NO: 463843 - DNA, 515 bp, Homo sapiens
  misc_feature: HEFZJCU01AGT4S.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtggcgttttcttaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactacttttgactacgtgggccgg

SEQ ID NO: 463844 - DNA, 517 bp, Homo sapiens
  misc_feature: HEFZJCU01DWXLW.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagtttattagtccctatttgacctatggggccaggggaactctggtcaccgtctccgcagcctccaccaaggcccatcc

SEQ ID NO: 463845 - DNA, 506 bp, Homo sapiens
  misc_feature: HEFZJCU01CV8AU.53.34.D01.1.454.heavy.3.raw
cgcgtatacacacgaccggtgctcgatttagatcgtctgtgttgggtttggggctgggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttggtccagcctggggggtccctgagactctcctgtgcagcctctggattgaccgtcagtagcaactacatgagctgggtccgccaggccccagggaaggggctggagtgggtctcaacaatttatagcggtggtaggacataccacgcagaccccgtgaagggccgattcaccatctccagacacaattccaagaacacactgtttcttcaaatggacttcctgagaactgaggacacggccgtgtattactgcgcgagagtgcatgatagtggtttccatgatgctttt

SEQ ID NO: 463846 - DNA, 339 bp, Homo sapiens
  misc_feature: HEFZJCU01EWHWO.47.38.D05.1.454.heavy.3.raw
agctcacgtacacgaccggtgctcgatttagtatctgatagttgggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccggtctcctcagcctccaccaagggcccatcggtcttccccctggcaccctcctccaagagcacctctggggcacagcggccctgggctgcctggtcaaggactacttcctacgtgagct

SEQ ID NO: 463847 - DNA, 513 bp, Homo sapiens; identical to SEQ ID NO: 446452
  misc_feature: HEFZJCU01C4KS7.17.33.C11.1.454.heavy.3.raw

SEQ ID NO: 463848 - DNA, 506 bp, Homo sapiens
  misc_feature: HEFZJCU01DJ4KA.53.62.F07.1.454.heavy.3.raw
cgcgtatacacacgaccggtgctcgatttagtagtcgcataaagggaaaggggtagtcgcataaagggaaagggggaggtgtgtcacaagatttgggctctgggagacgagcccagcactggaagtcgccggtgtttccattcggtgatcatcactgaacacagaggactcaccatggagtttgggctgagctgggttttcctcgttgctcttttaagaggtgtccagtgtcacgtgcagctggtgcagtctgggggagcgtggtccagcctgggaggtccctgaaactctcctgtgcagcctctggattcgtctcaagtgtctaccctatgcactgggtccgccaggctccaggcaagggggccggagtgggtggcacttatctcatctgatggaagagatgtctattacgcagactccgtgaagggccgattcaccatcctccagagacaattccaagaacacactgtatctgcaaatggacagtctgagaactgaagacacgg

SEQ ID NO: 463849 - DNA, 499 bp, Homo sapiens
  misc_feature: HEFZJCU01DJH0E.40.55.E11.1.454.heavy.3.raw
tctagcgactcacgaccggtgctcgatttagcactcgcacgttgggtttggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggaggtggattggggagtatttaccacagtgggagcacctactacaacccgtccctcaaaagtcgaggcaccatatccgtagacacgtccaagaaccaattctcctgaagctgagctctgtgaccgccgcagacacggctgtctattactgtgcgaggccccgagcgcagtggctttttgatgtcctttgatatgtggggccaaggggacaa

SEQ ID NO: 463850 - DNA, 520 bp, Homo sapiens
  misc_feature: HEFZJCU01BY80B.10.30.C08.1.454.heavy.3.raw
catagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatctgggggagccttggtacagcctggcgggtccctgagactctcctgtacagtctctggattcacctctgatgattatgccatgcactgggtccggcaagctccagggaagggcctggagtgggtctctggaatcacttacaatagtgatttccttaaatatgcggactctgtgagggggcgtttcaccatctccagagacaacgccaggaactccctctatctacaaatgaacagtctgagacctgaggacacggccttatatttctgtgcaaagatacttggagctggccgtgaccactggggccagggaaccct

SEQ ID NO: 463851 - DNA, 509 bp, Homo sapiens; identical to SEQ ID NO: 445824
  misc_feature: HEFZJCU01CAKMJ.9.14.B03.1.454.heavy.3.raw

SEQ ID NO: 463852 - DNA, 508 bp, Homo sapiens
  misc_feature: HEFZJCU01DLA53.17.25.C03.1.454.heavy.3.raw
cgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgaccatctgacgacacggcccgtctattactgtgcgagagtcccacgatccggtgagcctacggcagcggtcctttgacttcgtc

SEQ ID NO: 463853 - DNA, 536 bp, Homo sapiens
  misc_feature: HEFZJCU01CLCFV.52.12.B01.1.454.heavy.3.raw
cgcagtacgacacgaccggtgctcgatttagtagtgtagattccgcgggagtttccacttggtgatcagcactgaacacagaccaccaaccatggagtttgggcttagctgggttttccttgttgctattttaaaaggtgcccaatgtgaggtgcagctggtggagtctgggggaggcttggtgcagccagggcggtccctgagactctcctgttcagcttccggagtcacctttggtcattatgctatgaactgggtccgccaggctccagggaagggcctgtcttgggtaggtttcattagaggcgacgcttttggtgggacaacagaatacgccgcgtctgtgaaaggcagattcaccatctcaagagatgattccaaaagcgtcgtctacttgcaatgaacagcctgaaatccgaggacacagccgtgtattactgtactagagagtattggatcggggaaaattactaactccggtatggacgtctggggccaagggaccacggtcaccgtctcctcagcctccacctaac

SEQ ID NO: 463854 - DNA, 396 bp, Homo sapiens; identical to SEQ ID NO: 444469
  misc_feature: HEFZJCU01A30SL.47.46.E02.1.454.heavy.3.raw

SEQ ID NO: 463855 - DNA, 507 bp, Homo sapiens
  misc_feature: HEFZJCU01D9RIE.40.81.H04.1.454.heavy.3.raw
tctagcgactcacgaccggtgctcgatttagtagtgtagattcgcggggatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtggggcctcggtgaaggtctcctgcaagatttctggaaacaccctgagcaactactacatacactggatgcggcaggcccctggacaggggtttgagtggatggggtggagtcaaccctaccagaggtggcacaaagtatcgacagaactttcagggcagggtcaccatgacctgggacgcgtccatcagcacagtctacatggatctgagcggactgacctctgacgacacggccatgtattactgtgaaggagacgttggtggctaccggcgggctgaccactggggccaggggtaccc

SEQ ID NO: 463856 - DNA, 511 bp, Homo sapiens
  misc_feature: HEFZJCU01CAZ14.51.30.C08.1.454.heavy.3.raw
cgatcgtatacacgaccggtgctcgatttagtctgacgtcaaagggaaaggggctgggagacgagcccagcactcgaagtcgccggtgtttccattcggtgatcatcactgaacacagaggactcaccatggagtttgggctgagctgggttttcctcgttgctcttttaagaggtgtccagtgtcaggtgcggctggtggagtctgggggaggcgtggtccagcctggggattccctgagaatctcctgtgcagcctctggattcaacttcaatagacatcctatgcactgggtccgccaggctccaggcaaggggctggaatgggtggcagttatttcgtccactggaaacagtaaacattatggacgctccgtgaagggcccattcgccatctccagagacaattccaaaaataccctctatctgcgaatgaacagcctgcgacctgaagacacggctatatatttctgtgcgagaggggagtcttattgtaatgatggttcctgctt

SEQ ID NO: 463857 - DNA, 511 bp, Homo sapiens
  misc_feature: HEFZJCU01CHOLA.52.78.H01.1.454.heavy.3.raw
cgcagtacgacacgaccggtgctcgatttagtgtgagtagtttgggtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctgggggccaagggacaatggtcattgtctcttcacgcctccaccaagggcccatccggtcttccccctc

SEQ ID NO: 463858 - DNA, 526 bp, Homo sapiens
  misc_feature: HEFZJCU01DIP9C.49.9.A09.1.454.heavy.3.raw
agtcgagagacacgaccggtgctcgatttagcgagacgcgcgcagggggagccccagccctgggattcccagctgtttctgcttgctgatcaggactgcacacagagaactcaccatggagtttgggctgacctgggttttccttgttgctattttaaaaggtgtccagtgtgaagggcagctggtggagtccgggggaggcttggttcagcctgggggtccctaagactctcctgtgcagcctctggaatcgccttcaattaagttttggatgtactgggtccgccaagttccagggaaggggctgatgtgggtctcacgtattgatgttgatgggagttacagtgaccacgcggactctgtgaagggccgattcaccgtctccagagaaaacgccaagaacacggtgtatctgacaaatgactggcctgagagccgaggacacggcagtttatactgtgcaagagcttgtggtcgactgtcgacctggactggtacttcgatctgtcggggccgtggcctaccg

SEQ ID NO: 463859 - DNA, 482 bp, Homo sapiens; identical to SEQ ID NO: 444503
  misc_feature: HEFZJCU01E08KM.7.10.A10.1.454.heavy.3.raw

SEQ ID NO: 463860 - DNA, 521 bp, Homo sapiens; identical to SEQ ID NO: 445317
  misc_feature: HEFZJCU01BPOAN.12.40.D07.1.454.heavy.3.raw

SEQ ID NO: 463861 - DNA, 503 bp, Homo sapiens; identical to SEQ ID NO: 462172
  misc_feature: HEFZJCU01CJCH3.17.25.C03.1.454.heavy.3.raw

SEQ ID NO: 463862 - DNA, 506 bp, Homo sapiens
  misc_feature: HEFZJCU01CZEXS.51.35.D02.1.454.heavy.3.raw
cgatcgtatacacgaccggtgctcgatttagcacacgatagttgggtttggggagctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctaacaaatgaacagcctgagagctgaggacacggctattgttttactgtgcgaggagggaactcggattacagcacg

SEQ ID NO: 463863 - DNA, 531 bp, Homo sapiens
  misc_feature: HEFZJCU01D2A5W.47.78.H01.1.454.heavy.3.raw
agctcacgtacacgaccggtgctcgatttagtgtgagtagtttgggtttggggctctgggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtctgggggaggcctcataaagccgggggggtcccttaaactctcctgcgcagcgtctggatttcctttcagtcaagtctggataagctgggtccgccaggctccagggatgggcctggagtgggttggccgtgtcaagagcagaactgatggtgcgacatctgaatacgctgcacccgtgaaaggcagattcaccatctccagagatgattcaataaatatgtcatactctaacaagtgatacgctaagaaatcgaggaatacgaggttgtttattacttcgttccacgaggaagtgtcgttcttcggtcggggacggaggaact

SEQ ID NO: 463864 - DNA, 487 bp, Homo sapiens
  misc_feature: HEFZJCU01AF9CQ.10.1.A01.1.454.heavy.3.raw
catagtagtgcacgaccggtgctcgatttagacgtctcatcaggggctgggagaggagcccagcactagaagtcggcggtgtttccattcggtgatcagcactgaacacagaggactcaccatggagtttgggctgagctgggttttcctcgttgctcttttaagaggtgtccagtgtcaagtgcagctggcggagtctgggggaggcgtggtccagcctgggaggtccctgagactctcctgtgcagcctctgggttcaccttcaatacctatggcatgcactgggtccgccaggctccaggcaaggggctggagtgggtggctcttatctcatatgatggaaatgttaaattttatgcagactccgtgaagggccgattcaccatctccagagacaattccaggaacaccctgtatctgcaaatgaacagcctgagagctgacgacacggctgtttattactgtgcgacagagcagctgcttaaa

SEQ ID NO: 463865 - DNA, 513 bp, Homo sapiens; identical to SEQ ID NO: 446452
  misc_feature: HEFZJCU01B8PUX.17.33.C11.1.454.heavy.3.raw

SEQ ID NO: 463866 - DNA, 490 bp, Homo sapiens; identical to SEQ ID NO: 446494
  misc_feature: HEFZJCU01EI8SA.11.13.B02.1.454.heavy.3.raw

SEQ ID NO: 463867 - DNA, 524 bp, Homo sapiens; identical to SEQ ID NO: 446401
  misc_feature: HEFZJCU01CMIZY.3.82.H05.1.454.heavy.3.raw

SEQ ID NO: 463868 - DNA, 507 bp, Homo sapiens
  misc_feature: HEFZJCU01ENHSG.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgtgaaagatctcgggctggttccgcggtccggg

SEQ ID NO: 463869 - DNA, 513 bp, Homo sapiens
  misc_feature: HEFZJCU01CI3QD.3.71.G05.1.454.heavy.3.raw
agacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggattttccttttggctattttaaaaggtgtccggtgtgaagtgcaactggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtgataacatcggctatgcggactctgtgaagggccgattcaccatctccagagacaacgccaagaactccctgtatctgcaaatgaacagtctgagacctgaggacacggccttgtattactgtgtaagtcccggggaaatatagtacgtatttttggaactt

SEQ ID NO: 463870 - DNA, 535 bp, Homo sapiens
  misc_feature: HEFZJCU01ENHEG.51.26.C04.1.454.heavy.3.raw
cgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacgggggagttacttcctccgcaacggtatggacgtctggggccaagggaccacggtcaccgtctccttagcctccaccaagggcccatcggtcttccccctggccaccctcctccaagagcacctctc

SEQ ID NO: 463871 - DNA, 515 bp, Homo sapiens
  misc_feature: HEFZJCU01COUO9.49.41.D08.1.454.heavy.3.raw
agtcgagagacacgaccggtgctcgatttagtcacgcgagaaagggaaaggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcctagttcagcctggggggtccctgagactctcctgtgcagcctctggattcaccttcagtagctactggatggactgggtccgccaagctccagggaaggggctggtgtgggtctcacgtattaatagtgatgggagtagaaaaagctacgcggactccgtgaagggccgattctccatctccagagacaacgccaagaacacgctgtatctgcaaatgaacagtctgagagccgaggaaacggctgtgtattactgtgcagggtatcgaccgcgacacaaaattcgagatacagcccagtgactactc

SEQ ID NO: 463872 - DNA, 483 bp, Homo sapiens
  misc_feature: HEFZJCU01EJ2JL.51.86.H09.1.454.heavy.3.raw
cgatcgtatacacgaccggtgctcgatttagtgctatagacttgggtttggggagctctgggagacgagcccagcactggaagtcgccggtgtttccattcggtgatcatcaccgaacacagaggactcaccatggagtttggactgagctgggttttcctcgttgctcttttaagaggtgtccagtgtcaggtgcagctggtggactctgggggaggcgtggtccagcctgggaggtccctgagactctcctgtgcagcctctggattcaccttcaatacttatggcatgcactgggtccgccaggctccaggcaaggggctggagtggctgtcctttatctcatatgatggaggcaataaaaattatgcagactccgtgaagggccgattcaccatctccagagacaattccaagaacactctatatttgcagatgaatagcctgagaattgaggacacggctgtgtattactgtgtgaga

SEQ ID NO: 463873 - DNA, 400 bp, Homo sapiens; identical to SEQ ID NO: 444452
  misc_feature: HEFZJCU01A78ED.47.24.C02.1.454.heavy.3.raw

SEQ ID NO: 463874 - DNA, 517 bp, Homo sapiens
  misc_feature: HEFZJCU01BVEJ8.11.25.C03.1.454.heavy.3.raw
cgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccaggggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggccaa

SEQ ID NO: 463875 - DNA, 483 bp, Homo sapiens
  misc_feature: HEFZJCU01BQSZS.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacatttgactactggggccagggaaccctcgtcaccgtctcctcagcctccaccaagggcccatcggtcttcccctggcaccctcctccaagagcacctctgggggcacagcggccctgggctgcctggtcaaggactacttcctagagacacg

SEQ ID NO: 463876 - DNA, 513 bp, Homo sapiens; identical to SEQ ID NO: 446452
  misc_feature: HEFZJCU01BQKI4.17.33.C11.1.454.heavy.3.raw

SEQ ID NO: 463877 - DNA, 491 bp, Homo sapiens; identical to SEQ ID NO: 444803
  misc_feature: HEFZJCU01DRT0X.4.57.F02.1.454.heavy.3.raw

SEQ ID NO: 463878 - DNA, 526 bp, Homo sapiens
  misc_feature: HEFZJCU01B8168.10.30.C08.1.454.heavy.3.raw
catagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatctgggggagccttggtacagcctggcgggtccctgagactctcctgtacagtctctggattcacctctgatgattatgccatgcactgggtccggcaagctccagggaagggcctggagtgggtctctggaatcacttacaatagtgatttccttaaatatgcggactctgtgaggggcgtttcaccatctccagagacaacgccaggaactccctctatctacaaatgaacagtctggagacctgaggacacggccttatatttctgtgcaaaagatacttggagctggccgtgacctacgtgggggccaggggaaccctc

SEQ ID NO: 463879 - DNA, 531 bp, Homo sapiens
  misc_feature: HEFZJCU01D0T4R.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggccagggaaccctggtgaccgtctcctcagcctccaccaacgggcccatcggtcttccccctggccgccctgctccaggagcacctccgacgagcacagcggccctcgggtcg

SEQ ID NO: 463880 - DNA, 524 bp, Homo sapiens
  misc_feature: HEFZJCU01C3DEU.18.59.F04.1.454.heavy.3.raw
  modified_base (516)..(516): a, c, t, g, unknown or other
tacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaagggctggagtgggttggccgtattaaaaccaaaactgatggtgggacaacagactacgctgcacccgtgaaaggcagattcaccatctcaagagatgattcaaaagacacgctgtatctgcaaatgaacagcctgagaaccgaggacacagccgtgtattactgtaccacatcccctgaaagcgtcaactactactactacgtntggacctc

SEQ ID NO: 463881 - DNA, 510 bp, Homo sapiens; identical to SEQ ID NO: 445542
  misc_feature: HEFZJCU01DSACP.16.21.B10.1.454.heavy.3.raw

SEQ ID NO: 463882 - DNA, 527 bp, Homo sapiens
  misc_feature: HEFZJCU01CLO2H.12.33.C11.1.454.heavy.3.raw
atacgacgtacacgaccggtgctcgatttagagtgagctcgttgggtttgggagaggagccccagccctgagattcccacgtgtttccatccagtgatcagcactgaacacagaggactcgccatggagtctgggctgaactgggttttccttgttgctattttaaaaggtgtccactgtgaggtgcaactggtggagtcgggggaggtgtagtacggccgggggggtccctgagactctcatgtgcagggtctggattcaacttttacgattatggcatgacctgggtccgccaagctccagggaagggctggagtgggtctctggtctgaattggaatggtgatagtatagattatgcaggctctgtgagggccgattcaccatctccagagacaacgccaagaactccctgtttctacaaatggacaatttgagagaggaagacacggccttatatttctgtgcgagagccctcggcagaagtctggactacgtactattatggtatggacgtctggggtaccg

SEQ ID NO: 463883 - DNA, 493 bp, Homo sapiens
  misc_feature: HEFZJCU01DZZA5.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagccggcccgtgggctgcctggtcaaggactacttcccacgagagta

SEQ ID NO: 463884 - DNA, 519 bp, Homo sapiens; identical to SEQ ID NO: 444867
  misc_feature: HEFZJCU01AZF60.9.34.D01.1.454.heavy.3.raw

SEQ ID NO: 463885 - DNA, 532 bp, Homo sapiens
  misc_feature: HEFZJCU01D6VPQ.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcctttttacaccttcccttgacttctggggccatcggaaccccggtccg

SEQ ID NO: 463886 - DNA, 497 bp, Homo sapiens; identical to SEQ ID NO: 446430
  misc_feature: HEFZJCU01EWQ9I.51.78.H01.1.454.heavy.3.raw

SEQ ID NO: 463887 - DNA, 501 bp, Homo sapiens
  misc_feature: HEFZJCU01BAZ0M.40.31.C09.1.454.heavy.3.raw
tctagcgactcacgaccggtgctcgatttagacgtctcatcaaggaaggaagggggcttttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtgcttttgatgcctttgatatgtgggcaagggacaatgtcaccg

SEQ ID NO: 463888 - DNA, 525 bp, Homo sapiens
  misc_feature: HEFZJCU01CBNCA.49.67.G01.1.454.heavy.3.raw
agtcgagagacacgaccggtgctcgatttagagtatacatattgggtttggggacccaacaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcaacggtcgtcatgggatttgacttacgtggggccaggggaaccccggtcaccgtctcctctgcctccg

SEQ ID NO: 463889 - DNA, 507 bp, Homo sapiens
  misc_feature: HEFZJCU01ATKGV.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgccagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggacg

SEQ ID NO: 463890 - DNA, 405 bp, Homo sapiens; identical to SEQ ID NO: 446877
  misc_feature: HEFZJCU01D1C41.14.42.D09.1.454.heavy.3.raw

SEQ ID NO: 463891 - DNA, 515 bp, Homo sapiens
  misc_feature: HEFZJCU01C46WE.48.28.C06.1.454.heavy.3.raw
agtatacatacacgaccggtgctcgatttagagctcacgtattgggtttggggtttgggtgctgggcacggtgggcatgtgtgagttttgtcacaagatttgggctcaactctcctgtgcagcctctggattcacctttgatgattatgccatgcactgggtccggcaagttccagggaagggcctggagtgggtctcaggcattagtagaattaggggtagcatagcctatgcggattctgtgaagggccgattcaccatctccagagacaacgccaagaactccctgtatctgcaaatgaacagtctgagacctgaggacacggccttctattactgtgcaaaagatcaggcattagactacaacggtatggacgtctggggccaagggatcacggtcaccgtctcctcagcctccaccaagggcccatcggtcttccccctggcaccctcctccaacgagcaccctctgggggcacagcggccctgggctgcctggtcaaggactacttcct

SEQ ID NO: 463892 - DNA, 506 bp, Homo sapiens; identical to SEQ ID NO: 444696
  misc_feature: HEFZJCU01C467L.16.34.D01.1.454.heavy.3.raw

SEQ ID NO: 463893 - DNA, 514 bp, Homo sapiens
  misc_feature: HEFZJCU01ADZL3.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctggggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactacgtggggacccg

SEQ ID NO: 463894 - DNA, 508 bp, Homo sapiens
  misc_feature: HEFZJCU01B25DD.11.13.B02.1.454.heavy.3.raw
cgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccc

SEQ ID NO: 463895 - DNA, 524 bp, Homo sapiens
  misc_feature: HEFZJCU01BFNCG.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagcctggggggtccctgagactctcctgtgcagcctctggcttcaccgtcagtagcagctacatgcactgggtccgccaggctccagggaaggggctgggagtgggtctcagttatttacaattctggtaccacatactactccgaccccgtgaagggccgattaaccatctccagagacgattccgagaacacggtgtatcttcaatgaacaacctgagagccgacgacacggccgtttattactgtgcgagagattcgagtggttcggggacctcacctggtctacttcgatctctggggccgtc

SEQ ID NO: 463896 - DNA, 480 bp, Homo sapiens; identical to SEQ ID NO: 445011
  misc_feature: HEFZJCU01AGDA0.22.36.D03.1.454.heavy.3.raw

SEQ ID NO: 463897 - DNA, 528 bp, Homo sapiens
  misc_feature: HEFZJCU01DB0K5.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgtttctgcaatgaacagcctgagaattgaggactcgggtatatactactgtgcccgtcgaccccctcgacctgactaaaccggacctgggttccgtacccccgtgggggcccgacggggaaaccccgttgggtccacccggttcctccctccg

SEQ ID NO: 463898 - DNA, 515 bp, Homo sapiens
  misc_feature: HEFZJCU01B5KT7.4.1.A01.1.454.heavy.3.raw
agcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccaggggcctcagtcaagatttcctgtaaggcctctggatatacgttcattaactatgctatccattgggtgcgccaggcccccggacaaaacctgacgtggatgggttggatcaatggtgaaactggaaaaaccaaatattcaccgagcttccagggcagaatgaccatctcccgggacacatccgcgagcgcaatctatctggaactgagccgcctgacatctgcagactcggcagtatatttctgtgcgagagaggggaggatggttgagggaattgttattccatactactttgacctactggggccagggtaacccg

SEQ ID NO: 463899 - DNA, 432 bp, Homo sapiens; identical to SEQ ID NO: 444920
  misc_feature: HEFZJCU01CHIG5.11.39.D06.1.454.heavy.3.raw

SEQ ID NO: 463900 - DNA, 499 bp, Homo sapiens
  misc_feature: HEFZJCU01EL50V.13.33.C11.1.454.heavy.3.raw
tcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaataagaattgcaaacgatgcttttgatatgtggggacg

SEQ ID NO: 463901 - DNA, 520 bp, Homo sapiens
  misc_feature: HEFZJCU01A4KXR.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaacccgtggtcgccgtctcctcagcctccaccaagggcccatcggtcttcccctggccaccctcctccaagagcacctctgggggcacagcggccctgggctgcctggtcaaggactacttccagacgtatca

SEQ ID NO: 463902 - DNA, 501 bp, Homo sapiens
  misc_feature: HEFZJCU01CDPTQ.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcatcctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttcccctggcgccctgctccaggagcacctccgagagcacagcggccctgggctgcctggtcaggactacttcccacta

SEQ ID NO: 463903 - DNA, 527 bp, Homo sapiens
  misc_feature: HEFZJCU01A022W.11.25.C03.1.454.heavy.3.raw
cgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtcgtggggccgaagggaccacc

SEQ ID NO: 463904 - DNA, 482 bp, Homo sapiens; identical to SEQ ID NO: 444503
  misc_feature: HEFZJCU01D9LW9.7.10.A10.1.454.heavy.3.raw

SEQ ID NO: 463905 - DNA, 430 bp, Homo sapiens
  misc_feature: HEFZJCU01DU3HD.11.39.D06.1.454.heavy.3.raw
cgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgagggagtcctattacgcagctggctactacgttgacttctggggccaggggaccctggtcaccgtctcctcagcctccaccaagggcccatcggtcttccccctggcaccctcctccaagagcacctctggggcacagcggccctgggctgcctggtcaggactacttccgtatctctcg

SEQ ID NO: 463906 - DNA, 532 bp, Homo sapiens
  misc_feature: HEFZJCU01EZRG1.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgtagagcgtcgtctgtcagtggaattgactactgggccagggaaccctggtcaccgtctcctcagcctccaccaaggg

SEQ ID NO: 463907 - DNA, 511 bp, Homo sapiens
  misc_feature: HEFZJCU01D1HWF.11.72.G06.1.454.heavy.3.raw
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgataggcccctggacaaggacttgagtgggtgggatggatcaactctcacactggaagcagagtctatgcggagagattccagggcagagtcaccctgaccacagagacatccacgaccacagtctacatggagctgtggagcctgagacctgacgacaccggccctcttattactgtgcgaggccctatcctacagtcgaccactccacgctggttccgacctcgtggggccac

SEQ ID NO: 463908 - DNA, 392 bp, Homo sapiens; identical to SEQ ID NO: 444626
  misc_feature: HEFZJCU01EFRG1.49.46.E02.1.454.heavy.3.raw

SEQ ID NO: 463909 - DNA, 491 bp, Homo sapiens
  misc_feature: HEFZJCU01DYCAH.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttccccctggcaccctcctccaagagcacctctgggggcacagcggccctgggctgcctgtcaaggactacttccgagtgcgtct

SEQ ID NO: 463910 - DNA, 501 bp, Homo sapiens
  misc_feature: HEFZJCU01ALEM6.13.12.B01.1.454.heavy.3.raw
tcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaagggccgattcgccatctccagagacaattccaggaacacgctgtacctggagatggacggcctgagacctgacgacacggcaatttattactgtgcgagggtttatgtgttggaacgtggtacaccggaaaactggttcgacccctggggccagggaaccctggtcgtcgtctcgtctgcctccaccaagggcccatcggtcttccccctggcgccctgctccaggagcacctccgagagcacagcggccctgggctgcctggtcaaggactacttcctagtacgtga

SEQ ID NO: 463911 - DNA, 481 bp, Homo sapiens; identical to SEQ ID NO: 453118
  misc_feature: HEFZJCU01EX9G3.7.10.A10.1.454.heavy.3.raw

SEQ ID NO: 463912 - DNA, 545 bp, Homo sapiens
  misc_feature: HEFZJCU01ADWUE.49.77.G11.1.454.heavy.3.raw
agtcgagagacacgaccggtgctcgatttagctagtcactcaagggaaaggggcccctagatcacagctcctcaccatggactggacctggagcatccttttcttggtggcagcagcaacaggctcccactcccacttttatttgatgcagtctggggctgaggtgaagaagcctggggcctcagtgaaggtctcctgcacggcctctggtaacacctttaccagtcatggtattatctgggtgcgacaggcccctggacaagggcttgagtggatgggatgggtcagccctttcaatggtgagacaaactatgcacagaaactccagggcagagtcaccatgaccacagacacatccacgaccacagcctacatggagttgaggagcctgagatctgacgacacggccgtttatttctgtgcgaggagggggggccgtaccggtaagtttggtcgttggttatcgttagggtttgtaccggtagtggggccgacggggaacccccggtccgacccgtcctcctcacgccctccacccgaacggg

SEQ ID NO: 463913 - DNA, 510 bp, Homo sapiens
  misc_feature: HEFZJCU01COBPI.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggcgttttcttaggtggctattttaaaaggtgtccagtgtgaagtgcagctggtggagtctgggggaggcctggcacagccgggggggtccctgagactctcctgtgcagcctctggattcagttttagaatgtctgccatgacctgggtccgcaggctcctgggaaggggctggagtggatctcagggattagtggcactggcgattatacatattatacagactccgttgaagggccgcttcaccatctccagagacaattccaagaacacggtgtatctgcaaatgaacagcctgagagccgaggacacggccacatattactgtgcgaaagatctcgggctggttccgcggtccggg

SEQ ID NO: 463914 - DNA, 531 bp, Homo sapiens
  misc_feature: HEFZJCU01EO4VS.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacggctgtttattactgtgcgcggtggctgaccgctcttgactactgggggccgggggagccccgggtcagtcgtctcc

SEQ ID NO: 463915 - DNA, 398 bp, Homo sapiens; identical to SEQ ID NO: 444524
  misc_feature: HEFZJCU01EHRHH.7.60.F05.1.454.heavy.3.raw

SEQ ID NO: 463916 - DNA, 492 bp, Homo sapiens
  misc_feature: HEFZJCU01DDNGL.53.26.C04.1.454.heavy.3.raw
cgcgtatacacacgaccggtgctcgatttagtctagcgactttgggtttggggagcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcagggcagggtctccatgaccagggacaggggccatcagaacagcctacatggagctgaacagactgacatctgacgacacggccgtttattattgtgtgagagaggacccgatgacctc

SEQ ID NO: 463917 - DNA, 521 bp, Homo sapiens
  misc_feature: HEFZJCU01D6RS4.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgacccacagacacatccgcgaacacagcctacatggaactgaggaatctgacatctgacgacacggccatatattactgtgcgagaaggacggttttggggcgcggactcctcttgagatctggggccaggggacaatggtcaccgtctcttcag

SEQ ID NO: 463918 - DNA, 496 bp, Homo sapiens
  misc_feature: HEFZJCU01ACKWQ.11.57.F02.1.454.heavy.3.raw
cgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccagccgggggggtccctgagactctcctgtctagtctctggattcgccttcagtgactatgccatgaagtgggtccgccaggctccaggtaaggggctggaatggatttcatacattagcagtagtggtgcgaccatatactacacagactctgtgaagggccgattcatcatctccagagacaatggcaacaactcactgtatctggaaatcaacagcctgagagtcgaggacacggctgtatatttattgtgcgagacgccccctacggt

SEQ ID NO: 463919 - DNA, 514 bp, Homo sapiens
  misc_feature: HEFZJCU01BOOT6.13.87.H10.1.454.heavy.3.raw
tcacgtactacacgaccggtgctcgatttagcagtactgcgttgggtttgggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgcaaagatacccaaccccttacgatttttaggagtggttacg

SEQ ID NO: 463920 - DNA, 494 bp, Homo sapiens
  misc_feature: HEFZJCU01EK7LH.4.57.F02.1.454.heavy.3.raw
agcactgtagcacgaccggtgctcgatttagctcgatatagttgggtttgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaagttctatgcagactccggtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctgctccaggagcacctctgggggcacgagcggccctgggctgcctggtcaaggactacttccctacagtgct

SEQ ID NO: 463921 - DNA, 517 bp, Homo sapiens
  misc_feature: HEFZJCU01D7TA5.48.87.H10.1.454.heavy.3.raw
agtatacatacacgaccggtgctcgatttagcagtactgcgttgggtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttccccctcggccgccctgcctcc

SEQ ID NO: 463922 - DNA, 504 bp, Homo sapiens
  misc_feature: HEFZJCU01ED7U7.14.87.H10.1.454.heavy.3.raw
cgtctagtaccacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgagttcaccatctccagagacaacgccaagaactccctgtatctgcaatgaacagcctgagagctgaggacacggccttgtattatttgtgacaaaagataccaacccctacgtt

SEQ ID NO: 463923 - DNA, 509 bp, Homo sapiens
  misc_feature: HEFZJCU01EE56T.22.82.H05.1.454.heavy.3.raw
acatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgcgttttctaggtggctattttaaaacgtgtccagtgtgaggtgcagctggcggagtctgggggaggcctggtacagccgggggggtccctgagactctcctgtgtagcctccggattcacctttagcagacatggcatgagctgggtccgccaggctccagggaaggggccggagtgggtgtcagtcattagtagtagtggtgatagaatttaccacacagactccgtgaagggccgcttcaccatctctagagacaattcccagaacacactgtatctgcaaatgactaggctgagagccgacgacacggccatttattactgcgcgaaggatatacgggtcgacaacggtggctacgcgtt

SEQ ID NO: 463924 - DNA, 480 bp, Homo sapiens
  misc_feature: HEFZJCU01A68FN.49.6.A06.1.454.heavy.3.raw
agtcgagagacacgaccggtgctcgatttagatctactgacaggggagctctgagagaggagcccagccctgggattttcaggtgttttcatttggtgatcaggactgagcagagagaactcaccatggagtttgggctgagctggctttttcttgtggctattttaaaaggtgtccagtgtgaggtgcagctggtggactctgggggaggcttggtacagcctggggggtccctgagactctcctgtgcagcctctggattcaccttcagggtctatgacatgcactgggtccgccaggctccaggcaaggggctggagtgggtggcagttatatcatatgatggaagcaatatatactatgtagactccgtgaagggccgattcatcatctccagagacaattccgagaacacgctgtatctgcaaatgaacagcctgagagctgaggacacggctgtgtattactgtgacgtaactt

SEQ ID NO: 463925 - DNA, 506 bp, Homo sapiens
  misc_feature: HEFZJCU01BXW03.48.27.C05.1.454.heavy.3.raw
agtatacatacacgaccggtgctcgatttagacgcgatcgaaggggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggactacttcctatgtatact

SEQ ID NO: 463926 - DNA, 509 bp, Homo sapiens; identical to SEQ ID NO: 445824
  misc_feature: HEFZJCU01ALHB8.9.14.B03.1.454.heavy.3.raw

SEQ ID NO: 463927 - DNA, 396 bp, Homo sapiens; identical to SEQ ID NO: 444469
  misc_feature: HEFZJCU01B7FOU.47.46.E02.1.454.heavy.3.raw

SEQ ID NO: 463928 - DNA, 509 bp, Homo sapiens
  misc_feature: HEFZJCU01B8ZTH.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctcattccgttcatctgatactggggccagggaacctggtcgtccg

SEQ ID NO: 463929 - DNA, 507 bp, Homo sapiens; identical to SEQ ID NO: 453371
  misc_feature: HEFZJCU01EGDFR.11.13.B02.1.454.heavy.3.raw

SEQ ID NO: 463930 - DNA, 526 bp, Homo sapiens
  misc_feature: HEFZJCU01EVJA7.12.58.F03.1.454.heavy.3.raw
atacgacgtacacgaccggtgctcgatttagtctgatcgagaagggaaaggggcagagaggagccttagccctggactccaaggcctttccacttggtgatcagcactgagcacagaggactcaccatggaattggggctgagctgggttttccttgttgctattttagaaggtgtccagtgtgagggacaattggtggagtctgggggaggcttggtccagccgggggggtccctgagactctcctgtacagcctctggattcactctcggaaacttttggatggtctgggtccgccaggctccagggaaggggctggagtgggtggccaatatacagtcaggtggaggtacgatacactatctcgactctgtgaagggccggttcaccatctccagagacaacgccaagaattcactgtatctgcaaatgaacagcctgagagtcggaagacacgggtatttattattgtgtgcgagatctggatttccttcgaaatgaagtgtggttcgatgtgtttgattcg

SEQ ID NO: 463931 - DNA, 515 bp, Homo sapiens
  misc_feature: HEFZJCU01EKQTM.19.67.G01.1.454.heavy.3.raw
tactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgaggggccgaggacacggccgtctattattgtgtgagtagtttatgggcgatggctgggtggacaggatcacgtc

SEQ ID NO: 463932 - DNA, 336 bp, Homo sapiens; identical to SEQ ID NO: 444510
  misc_feature: HEFZJCU01BLSUD.3.31.C09.1.454.heavy.3.raw

SEQ ID NO: 463933 - DNA, 512 bp, Homo sapiens
  misc_feature: HEFZJCU01DHGHJ.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgttcttcaaatgaacagcctgagagccgatgacacggccgtgtattactgtgcgagagatggggcccacgaacgttactacgctatggacgtctggggaccg

SEQ ID NO: 463934 - DNA, 503 bp, Homo sapiens
  misc_feature: HEFZJCU01B0WX6.48.81.H04.1.454.heavy.3.raw
agtatacatacacgaccggtgctcgatttagtagtgtagattcgcggggatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcgcggggaggtggacggagctcggtttcggagttatcatctactactttg

SEQ ID NO: 463935 - DNA, 522 bp, Homo sapiens
  misc_feature: HEFZJCU01C17TG.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgacccgtgaagggccgattaaccatctccagagacgattccgagaacacggtgtatcttcaaatgaacaacctgagagccgacgacacggccgtttattactgtgcgagagattcgagtgggttcggggacctcaccctggttctacttcgatctctggggcc

SEQ ID NO: 463936 - DNA, 518 bp, Homo sapiens
  misc_feature: HEFZJCU01AFYQT.48.70.G04.1.454.heavy.3.raw
agtatacatacacgaccggtgctcgatttagtgtagtgtgaagggaaagggggaacacagaggactcaccatggagtttgggctgagctggattttccttgctgctattttaaaaggtgtccagtgtgaggtgcagctggtgcagtccggggggggcctggtaccgcctggggggtcccttagactctcctgtgcagcctctggattcatcttcagtaatgtctggatgacctggttccgccaggctccagggaaggggctggagtgggttggccgtgttaaaaccaagctgagggtgggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactgactattggggccagggaaccctggtcaccgtctcctcagcctccaccaacgggcccatccggtcttcccc

SEQ ID NO: 463937 - DNA, 510 bp, Homo sapiens
  misc_feature: HEFZJCU01BXMGD.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgtttcgatgccttcggtccgcgggacttctggggccagggtaaccc

SEQ ID NO: 463938 - DNA, 425 bp, Homo sapiens
  misc_feature: HEFZJCU01C4QZ6.9.34.D01.1.454.heavy.3.raw
tgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactgggccggggaaccctggtcgccgtctcctcagcctccaccaagggcccatcggtcttccccctggcaccctcctccaagagcacctctgggggcacagcggccctgggctgcctggtcaggactacttccagacgtatca

SEQ ID NO: 463939 - DNA, 537 bp, Homo sapiens
  misc_feature: HEFZJCU01DGU13.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttgggccgagggaaccctggtcaccgtctcctcagcctccaccaagggcccatcggtcttcccctggccaccctcctcccaagagcacctcgtgggggcacgagcggccctggggcctgcct

SEQ ID NO: 463940 - DNA, 503 bp, Homo sapiens
  misc_feature: HEFZJCU01DACXD.40.81.H04.1.454.heavy.3.raw
  modified_base (440)..(440): a, c, t, g, unknown or other
tctagcgactcacgaccggtgctcgatttagtagtgtagattcgcggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcgggctggacctcgtgacgacncggccatgtattactgtggaagagagttggtggctaccgcgggggctgacccactggggcccg

SEQ ID NO: 463941 - DNA, 504 bp, Homo sapiens
  misc_feature: HEFZJCU01CI6BB.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgagggccgattcaccatctccagagacaattccaagaacacgctgtttcttcaaatgaacagcctgagagccgatgacacggccgtgtattactgtgcgagagatggggcccacgaacgttactacgctatggacgtcgt

SEQ ID NO: 463942 - DNA, 490 bp, Homo sapiens; identical to SEQ ID NO: 456369
  misc_feature: HEFZJCU01D56GY.48.20.B09.1.454.heavy.3.raw

SEQ ID NO: 463943 - DNA, 516 bp, Homo sapiens
  misc_feature: HEFZJCU01ENI5V.22.73.G07.1.454.heavy.3.raw
acatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagttactactggagctggctccggcagtccccagggaagggactggagtggattgggtatatctattacactgggagcaccgactacagcccctccctcatgagtcgagtcaccatttcactagacacgtccaagaaccagttctccctgaaactgaggtctgtgaccgctgcggacacggccgtctattactgtgcgagatttgctttttggagtggttacgccgcgtttgactactggggccagggaaccctggtcaccgtctcctcagcctccaccaac

SEQ ID NO: 463944 - DNA, 534 bp, Homo sapiens
  misc_feature: HEFZJCU01B8FSV.19.48.E04.1.454.heavy.3.raw
tactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagcctggggggtccctgagactctcctgtacaggctctgggttctcctttagtagttattggatgaactgggcccgccaggctccggggaaggggccggagtgggtggccaacataatgcaagatggaactgagaaaaactatggggactctgtgaagggccgattcaccatctccagagacaaccgtaagaacttactgtttctgcaaatgaacagcctgagagccgaggacacggctgtgtattattgtgcgaaggggcagtggctggggacatggacgtctgggggccaagggaccacggtcaccgt

SEQ ID NO: 463945 - DNA, 499 bp, Homo sapiens
  misc_feature: HEFZJCU01DHMCH.11.73.G07.1.454.heavy.3.raw
cgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggaggcttggtacagcctggacggtccctgagactctcctgtgcagcctctggatacatcttcaaaagtttcgaaatgagctgggtccgccaggctcctgggaaggggccggagtggatttcatacatcagtagtagtggtaacaccttgtactatgcagactctgtgaagggccgattcaccatctccagagacaacgccaagaattcactgtttctgcaaatgaacagcctgagagacgaggatacggctatttactattgtgcgcgatcgacagaaaaagcggtggcctatc

SEQ ID NO: 463946 - DNA, 537 bp, Homo sapiens
  misc_feature: HEFZJCU01AVDZS.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaatgaataacctgagagccgaggacacggccatgtattactgtgtgggggcatttacttgtaccccgtggggccggggaacccgtggtccaccgtcctccccacccctcccaaccg

SEQ ID NO: 463947 - DNA, 513 bp, Homo sapiens
  misc_feature: HEFZJCU01BZX8T.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggcctaac

SEQ ID NO: 463948 - DNA, 476 bp, Homo sapiens
  misc_feature: HEFZJCU01AKECO.48.71.G05.1.454.heavy.3.raw
agtatacatacacgaccggtgctcgatttagtgtcgtcgcaagagagagggggcatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtatagcaaactacgcacagaagttccagggcagagtcacgattaccgcggacaaatccacgagcacagcctacatggagctgagcagcctgagatctgaggacacggccgtgtattactgtgcgagagatcagagtggtt

SEQ ID NO: 463949 - DNA, 483 bp, Homo sapiens; identical to SEQ ID NO: 444924
  misc_feature: HEFZJCU01A8HB6.10.35.D02.1.454.heavy.3.raw

SEQ ID NO: 463950 - DNA, 478 bp, Homo sapiens; identical to SEQ ID NO: 448105
  misc_feature: HEFZJCU01EMHRK.26.78.H01.1.454.heavy.3.raw

SEQ ID NO: 463951 - DNA, 510 bp, Homo sapiens
  misc_feature: HEFZJCU01DBPWP.10.71.G05.1.454.heavy.3.raw
catagtagtgcacgaccggtgctcgatttagtgtcgtcgcaagagagaggggggaggagcccagcactagaagtcggcggtgcctccattcggtgatcagcactgaacacagaggactcaccatggagtttgggctgagcgtgggttttcctcgttggctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagaggccgagggacacggggtgtttatttactgtagggagaaagttcctagtgggcatcacctggtaattt

SEQ ID NO: 463952 - DNA, 379 bp, Homo sapiens; identical to SEQ ID NO: 444450
  misc_feature: HEFZJCU01BSAJI.47.77.G11.1.454.heavy.3.raw

SEQ ID NO: 463953 - DNA, 496 bp, Homo sapiens; identical to SEQ ID NO: 445798
  misc_feature: HEFZJCU01BDI9Z.12.55.E11.1.454.heavy.3.raw

SEQ ID NO: 463954 - DNA, 523 bp, Homo sapiens
  misc_feature: HEFZJCU01BYJRC.53.10.A10.1.454.heavy.3.raw
  modified_base (521)..(521): a, c, t, g, unknown or other
cgcgtatacacacgaccggtgctcgatttagcgtcgatctcaggggtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgagggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgccctccaggggggacctttgggggtttcgacccctggggccaggggaaccctggtcaccgtctcctcagcctccaccaagggcccatcggtcttcccctggccaccctcctccaaganca

SEQ ID NO: 463955 - DNA, 515 bp, Homo sapiens
  misc_feature: HEFZJCU01A4YX7.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaaggcccatcggtcttccccctggcaccctcctccaagagcacctctggggcacagcggcctggctgcctggtcaaggactacttccagacgtatca

SEQ ID NO: 463956 - DNA, 501 bp, Homo sapiens; identical to SEQ ID NO: 460943
  misc_feature: HEFZJCU01D2B45.51.71.G05.1.454.heavy.3.raw

SEQ ID NO: 463957 - DNA, 382 bp, Homo sapiens
  misc_feature: HEFZJCU01C1LPC.47.60.F05.1.454.heavy.3.raw
agctcacgtacacgaccggtgctcgatttagtacgtcatcagggaaagggactggagtggattggctatctgtattacggtgggagttcaaacttcaacccctccctcaagagtcgagtcaccatttcaggagacacgtccaagaatcaggtctccttgaacctgaggcagacgaccccagcggacacggccgtctattattgtgcgagaggtcttcttgatgacgatgccctggacgactggggccagggagtccttgtcaccgtctcctcagcctccaccaagggcccatcggtcttccccctggcaccctcctccaagagcacctctgggggcacagcggcctgggctgcctggtcaaggactacttcctacgtgagct

SEQ ID NO: 463958 - DNA, 499 bp, Homo sapiens
  misc_feature: HEFZJCU01ECP10.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctccgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctaccaaaaaccaggtggtccttacaatgaccaacatggaccctgtggacacagccacatattactgtgcacagagatacgggcagcacgtggtttgggctacgtggggccagggaaccctggtcaccgtctcctcagcctccaccaac

SEQ ID NO: 463959 - DNA, 429 bp, Homo sapiens; identical to SEQ ID NO: 447944
  misc_feature: HEFZJCU01B8VRD.4.37.D04.1.454.heavy.3.raw

SEQ ID NO: 463960 - DNA, 513 bp, Homo sapiens
  misc_feature: HEFZJCU01C48QJ.13.71.G05.1.454.heavy.3.raw
tcacgtactacacgaccggtgctcgatttagtgtcgtcgcaagagagaggagccttagccctggactccaaggcctttccacttggtgatcagcactgagcacagaggactcaccatggaattggggctgagctgggttttccttgttgctattttagaaggtgtccagtgtgaggtgcagctggtggagtctggggggggcttggtccagcctggggggtccctgagactctcctgtgcagcctctggattcactttttagtaggtattggatgggttgggtccgccagactccagagaagggactggagtgggtggccaacataaaggaagatggaagtgaaagatactatgtggactctgtgaagggccgattcaccatctccagagacaacgccaagaactcactgtatctgcagatgaccagcctgagagtcgaggatacggctgtgtattattgtgcgagagatgggggcacgacattttgtagaggtgtactggggccaggggacg

SEQ ID NO: 463961 - DNA, 484 bp, Homo sapiens
  misc_feature: HEFZJCU01DAJ9D.48.39.D06.1.454.heavy.3.raw
  modified_base (478)..(478): a, c, t, g, unknown or other
agtatacatacacgaccggtgctcgatttagtgacatctcgcagttctttggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtcttttgatgctttgatntgtggg

SEQ ID NO: 463962 - DNA, 503 bp, Homo sapiens; identical to SEQ ID NO: 445995
  misc_feature: HEFZJCU01CG1C6.17.25.C03.1.454.heavy.3.raw

SEQ ID NO: 463963 - DNA, 532 bp, Homo sapiens
  misc_feature: HEFZJCU01BRJIU.40.70.G04.1.454.heavy.3.raw
tctagcgactcacgaccggtgctcgatttagtgtagtgtgaagggaaagggtctccgaagccttcggagaccctgtccctcacctgcactgtctctggtgcctccatcagcagtactagttactactggggctggatccgccagtccccagggaagggactggagtggattgcggctatttcttatagtgagaacacctactacaacccgtccctcaagagtcgagtcaccatatccgtagacacgtccaacaaccagttctccctgaacctgagccctgtgaccgtcgcagacacggctgtatattattgtgggagacgctttcgtgacttaggccctgactacggtggcccccataccgaggacgatttcctcggtatggacgtctggggccaagggaccacggttaccgtctcctcagcctccaccaagggcccatcggtcttccccctcggcgccctgctccaggagcacctccgagagcacagcggccctgggcgtgcctggtcaaggactacttccagtcgctaga

SEQ ID NO: 463964 - DNA, 515 bp, Homo sapiens
  misc_feature: HEFZJCU01AVMTH.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtcgtggggaccg

SEQ ID NO: 463965 - DNA, 511 bp, Homo sapiens
  misc_feature: HEFZJCU01B1MSN.11.13.B02.1.454.heavy.3.raw
cgagagataccacgaccggtgctcgatttagtctagcgactttgggttctccttgttgctattttagaagttgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggccgccctgctccaggagcacctccgagagcacagcggccctgg

SEQ ID NO: 463966 - DNA, 510 bp, Homo sapiens
  misc_feature: HEFZJCU01B1LRO.4.23.C01.1.454.heavy.3.raw
agcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatgcacagacgttccagggcagagtcaccattaccacagacacatccacgagcacagcctacatggacctgaggagcctgagatttgacgacacggccatatattactgtgcgagagattgggccgacggaaaccttgactactggggccagggaaccctggtcacgt

SEQ ID NO: 463967 - DNA, 495 bp, Homo sapiens; identical to SEQ ID NO: 446614
  misc_feature: HEFZJCU01AJ7LK.13.85.H08.1.454.heavy.3.raw

SEQ ID NO: 463968 - DNA, 532 bp, Homo sapiens
  misc_feature: HEFZJCU01A8HH0.47.6.A06.1.454.heavy.3.raw
agctcacgtacacgaccggtgctcgatttagatctactgacagcacacaagggggggaaatactttctgagagtcctggacctcctgtgcaagaacatgaaacatctgtggttcttccttctcctggtggcagctcccacatgggtcctgtcccaggtgcagctgcaggagtcgggcccaggactggtgaagccttcggagaccctgtccctcacttgcactgtctctggtggctccatcaggagttactactggacctggcttcggcagtccccagggaagggactggagtggattgggtataattattacagtgggaccaccaactacaacccctccctcaagagtcgagtcaccatatcaatagacacgtcgaagaaccagttctccctgaacgttgaactcagtgaccgctgcggacacgccgtgtattactgtgcgagccacaccgattacgatttttggagtggccttgataaactggggccagggggatccgtggtcaccggtctcctcacgcctcccaccaacc

SEQ ID NO: 463969 - DNA, 513 bp, Homo sapiens
  misc_feature: HEFZJCU01BBU88.22.36.D03.1.454.heavy.3.raw
acatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacagccgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgagggggccgcttcatcatctccagagacgattccgaaaacacagtgaatctgcaaatgtacagcctcagcgccgaggacacggccgtctacttctgtgcgaaagacctctattttggccgcggccgactactggggccac

SEQ ID NO: 463970 - DNA, 517 bp, Homo sapiens
  misc_feature: HEFZJCU01CGV9P.12.33.C11.1.454.heavy.3.raw
atacgacgtacacgaccggtgctcgatttagagtgagctcgttgggtttggggggaagaggaagactgacggtccccccaggagttcaggtgctgggcacggtgggcatgtgtgagttttgtcacaagatttgggctcaactctcatgtgcagggtctggattcaactttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttcccctggcaccctcctccagagcacctctgggggc

SEQ ID NO: 463971 - DNA, 482 bp, Homo sapiens; identical to SEQ ID NO: 444503
  misc_feature: HEFZJCU01A0A4T.7.10.A10.1.454.heavy.3.raw

SEQ ID NO: 463972 - DNA, 521 bp, Homo sapiens; identical to SEQ ID NO: 445317
  misc_feature: HEFZJCU01C6F23.12.40.D07.1.454.heavy.3.raw

SEQ ID NO: 463973 - DNA, 501 bp, Homo sapiens; identical to SEQ ID NO: 447123
  misc_feature: HEFZJCU01C39BW.3.20.B09.1.454.heavy.3.raw

SEQ ID NO: 463974 - DNA, 514 bp, Homo sapiens
  misc_feature: HEFZJCU01EONVR.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctggggaggtcacagagactctcctgtgcagcctctgggttcaccttcagtagctacggcatgcactgggtccgccaaactccaggcaagggattggagtgggtgcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaagggaggggggaaccaggcgggagtccaagtctcttg

SEQ ID NO: 463975 - DNA, 399 bp, Homo sapiens
  misc_feature: HEFZJCU01E1Y8O.18.1.A01.1.454.heavy.3.raw
tacgagtatgcacgaccggtgctcgatttagacgtctcatcaaggaagggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactggggccagggcgactccggtcaccgtctcctcagcctccaccaagggcccatcggtcttccccctcggcgccctgctccaggagcacctccgagagcacagcggccctgggctgcctggtcaaggactacttcccatactcgta

SEQ ID NO: 463976 - DNA, 513 bp, Homo sapiens
  misc_feature: HEFZJCU01CZQWT.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgccgtggggccaagggaccacggtcatcgtctccgcagcctccaccaagggcccatcggtcttcccctggcaccctcctccaagagcacctctgggggcacagcggccctgggctgcctggtcaaggactacttccgagtgcgtct

SEQ ID NO: 463977 - DNA, 519 bp, Homo sapiens
  misc_feature: HEFZJCU01DXP7B.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgccctgctccagagcacctctggggcacacgccgccgtcggctcgccgtcggtacgacggactaccttccactaccg

SEQ ID NO: 463978 - DNA, 508 bp, Homo sapiens
  misc_feature: HEFZJCU01EXUSX.4.67.G01.1.454.heavy.3.raw
  modified_base (467)..(467): a, c, t, g, unknown or other
  modified_base (484)..(484): a, c, t, g, unknown or other
agcactgtagcacgaccggtgctcgatttagagtatacatattgggtttggggtctgagagaggagcccagccctgggattttcaggtgttttcatttggtgatcaggactgaacagagagaactcaccatggagtttgggctgagcggcgtgtttctaggtcggctaattttaaaaggtgtcagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggacacggccacntaattctgtgcgaaagntctgggctggttccgcggtccggg

SEQ ID NO: 463979 - DNA, 497 bp, Homo sapiens
  misc_feature: HEFZJCU01ER6J3.10.12.B01.1.454.heavy.3.raw
catagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatctgggggaggcgtggtccagccagggaggtccctgagactctcctgtgcagcctctggattgaggttcaataactatgctatgcactgggtccgccaggctccagggaaggggctggaatggatgacagttatttcacacgatgcaaccaaaaacatactacgcggagttcgtgaggggccgctgcatcgtctccagagacaattcgaagaacactctgtacctgcaaatgaacagtctgagagccgaggacacggccgtctacttttgtgcgactagaagtgggagctagt

SEQ ID NO: 463980 - DNA, 505 bp, Homo sapiens
  misc_feature: HEFZJCU01DGE8K.16.2.A02.1.454.heavy.3.raw
tgtactactccacgaccggtgctcgatttagactcatctacagggggagagaggagccttagccctggattccaaggcctatccacttggtgatcagcactgaccaccgaggattcaccatggagctggggctccgctgggttttccttgttgctattttagaaggtgtccagagtgaggtgcagctggtggagtttgggggaggcctggtcaagcctggggggtccctgagactctcctgtgcagcctctggattcacctttgacagctatgccatgacctgggtccgccaggctccaggaagggctggaatgggtctcaggtattactggtggtggttataccacatactacgcagactccgtgaagggccggttcaccatctccagagacaattccaagaacacactgtatctgcaaatgaacagcctgagagccgacgacacggccatatattaactgtgacgaaagcaccggcagttagtcacccatactacttgactac

SEQ ID NO: 463981 - DNA, 519 bp, Homo sapiens
  misc_feature: HEFZJCU01ELRQ1.21.76.G10.1.454.heavy.3.raw
tcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaacctgggggtccctgagactctcctgtgcggtctctgggttcaccgtcactactaactccatgagctgggtccgccaggctccagggaaggggctgggagtgggtctcagttatttatagtggtggtggtgcagattacgcagactccgtgaagggccgattcaccatctccagagacaattccatgaacacgctgtatcttcaaatgaacagcctgagagccgacgacacggccgtctattactgtgcgacgggagtggacgggaggaggggcagtggatacgtttgaccacgtgggggacg

SEQ ID NO: 463982 - DNA, 527 bp, Homo sapiens
  misc_feature: HEFZJCU01DKBOH.13.38.D05.1.454.heavy.3.raw
tcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtctgggggggcttggttaagcctggggggtccctcagactctcctgtgcaacctctggattcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccaagggacc

SEQ ID NO: 463983 - DNA, 543 bp, Homo sapiens
  misc_feature: HEFZJCU01D17G3.53.68.G02.1.454.heavy.3.raw
  modified_base (364)..(364): a, c, t, g, unknown or other
cgcgtatacacacgaccggtgctcgatttagtcgatagtgaagggaaaggggcacaagaacatgaaacacctgtggttcttcctcctcctggtggcagctcccagatgggtcctgtcccaggtgcagctgcagcagtggggctcaggactgttgaagccttcggagaccctgtccctcacgtgcgctgtctatggtgggtcattcagtgattattattggacctggatccgccaggccccagggaaggggctggagtggatagcggaaatcaatcatagtggaaagactacctacaacccgtccctcaagagtcgagtcaccttatcggtagacacgcccaagaagcagttctccctgagggtnacgtctgtgaccgccgcggacacggctgtctattactgtgcgagaggccccttagtttcggtttttggactggttctcccatggaatccctactttgagtactggggccgcggagccctggtcaccgtctcctcacgcctccaccaacgggcccagtcggtccttcccctggccaccct

SEQ ID NO: 463984 - DNA, 512 bp, Homo sapiens
  misc_feature: HEFZJCU01DZN8I.9.34.D01.1.454.heavy.3.raw
tgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaaggcccatcggtctcccctgcaccctcctccagagcacctctgggggcacagcggccctgggctgcctgtcaaggactacttccagacgtatca

SEQ ID NO: 463985 - DNA, 400 bp, Homo sapiens; identical to SEQ ID NO: 444452
  misc_feature: HEFZJCU01DQ0JY.47.24.C02.1.454.heavy.3.raw

SEQ ID NO: 463986 - DNA, 534 bp, Homo sapiens
  misc_feature: HEFZJCU01DWLDY.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaaggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgaggagggacggacgtacggtgacttacgtgggggttcgaccccgtcggggccgacgggaaccctggtccaccgtctcctcagcctccaccg

SEQ ID NO: 463987 - DNA, 491 bp, Homo sapiens; identical to SEQ ID NO: 445333
  misc_feature: HEFZJCU01CWV7G.19.53.E09.1.454.heavy.3.raw

SEQ ID NO: 463988 - DNA, 478 bp, Homo sapiens
  misc_feature: HEFZJCU01BD9EH.48.68.G02.1.454.heavy.3.raw
agtatacatacacgaccggtgctcgatttagtcgatagtgaagggaaaggggatcatccaacaaccacatcccttctctacagaagcctctgagaggaaagttcttcaccatggactggacctggagggtcttctgcttgctggctgtagctccaggtgctcactcccaggtgcagctggtgcagtctggggctgaggtgaagaagcctggggcctcagtgaagatttcctgcaaggcatctggatacatcttcaccacctacaatatacactgggtgcgacaggcccctcgacaagggcctgagtggatggggatgatcaaccctaggtatggcagcacaagccacgcagagaagttccagggcagagttatcatgaccagcgacacgtccacgagcacagtctacatgagtctgagcagcctgagatctgaagacacggccgttctattactgtgcgagagggggggtgggtcccc

SEQ ID NO: 463989 - DNA, 508 bp, Homo sapiens
  misc_feature: HEFZJCU01DHO93.22.11.A11.1.454.heavy.3.raw
acatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctgggttcaccgtcagtagcaagtacatgagctgggtccgccaggctccagggaaggggctggagtggatctcagttatttatctcggtggtaacacatactacgcagactccgtggagggccgattcaccatctccagagacaattccaagaacacggtgtatcttcaaatgaacagcctgagagccgatgacacggccgtgtattactgtgtgagatcaaaattccaagccgcgggggtcacccaaattgactactc

SEQ ID NO: 463990 - DNA, 507 bp, Homo sapiens
  misc_feature: HEFZJCU01DEXVE.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcgccatctccagagacaattccaagaacacgcagtatctgcaaatgaacagcctgagagctgaggacacggctgtgtattactgtgggagagatggaggtcgatattgtagtggtggtagctgctataactggatcgaccctgggccagggaaccctggtcacgtctcctcagcctccaccaagggcccatcggtcttcccctggcaccctcctccaagagcacctctgggggcacagcggcctgggctgcctggtcaaggactactccgtatacg

SEQ ID NO: 463991 - DNA, 513 bp, Homo sapiens
  misc_feature: HEFZJCU01EVTU7.26.12.B01.1.454.heavy.3.raw
agactatactcacgaccggtgctcgatttagtagtgtagattccgcgggggggagaggagccccagccctgagactcccaggtgcttccattcagtgatcagcactgaacacagaggactcaccatggagttgggactgaactggattttccttttgaccattttaaaaggtgtccagtgtgaagggcagctggtggagtctgggggagacttggtccagcctggcaagtccctaagactctcctgtgtcgcttctggattcacctttgatgaatatgccatgcactgggtccgtcaggcaccagggaggggcctggagtgggtctcaggtatcagttacaatagtggtaatatactctatgcggactctgtgaagggcgattcaccatctccagagacaacgccaggaactccctctatctagaaatggacagtctgacaactgaggacacgccttttatttctgtgcaaaggtggaaccgacatatttcacaagctggcactggtacttcg

SEQ ID NO: 463992 - DNA, 507 bp, Homo sapiens; identical to SEQ ID NO: 446827
  misc_feature: HEFZJCU01EF8X8.10.38.D05.1.454.heavy.3.raw

SEQ ID NO: 463993 - DNA, 525 bp, Homo sapiens
  misc_feature: HEFZJCU01EX9U8.47.6.A06.1.454.heavy.3.raw
agctcacgtacacgaccggtgctcgatttagatctactgacagcacacaagggggggaaatactttctgagagtcctggacctcctgtgcaagaacatgaaacatctgtggttcttccttctcctggtggcagctcccacatgggtcctgtcccaggtgcagctgcaggagtcgggcccaggactggtgaagccttcggagaccctgtccctcacttgcactgtctctggtggctccatcaggagttactactggacctggcttcggcagtccccagggaagggactggagtggattggggtataattattacagtgggaccaccaactacaacccctccctcaagagtcgagtcaccatatcaatagacacgtcgaagaaccagttctccctgaagttgaactcagtgaccgctgcggacacggccgtgtattactgtgcgagccacaccgattacgtattttggagtggccttgataactggggccaggggatcctggtcaccgtctcctcagcctccaccac

SEQ ID NO: 463994 - DNA, 510 bp, Homo sapiens; identical to SEQ ID NO: 452229
  misc_feature: HEFZJCU01A0LPY.11.13.B02.1.454.heavy.3.raw

SEQ ID NO: 463995 - DNA, 490 bp, Homo sapiens
  misc_feature: HEFZJCU01DW1DO.40.81.H04.1.454.heavy.3.raw
tctagcgactcacgaccggtgctcgatttagtagtgtagattcgcgggcacgaccggtgctcgatttagtagtgtagattcgcgggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtatta

SEQ ID NO: 463996 - DNA, 520 bp, Homo sapiens; identical to SEQ ID NO: 451524
  misc_feature: HEFZJCU01CEM2S.14.57.F02.1.454.heavy.3.raw

SEQ ID NO: 463997 - DNA, 526 bp, Homo sapiens
  misc_feature: HEFZJCU01DT8LZ.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttggttcgtggggccaggggaccctggtcatcgtctccccagcctccaccacgggcccatccggtcttccccctggccg

SEQ ID NO: 463998 - DNA, 511 bp, Homo sapiens
  misc_feature: HEFZJCU01DPBJB.26.57.F02.1.454.heavy.3.raw
agactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccggtggggtccctgaaactctcatgtgcaggctctggattcacattcagtgactcggctatatactgggtccgccagtctgccgggaaagggctggagtggcttggccgtattagaaccaaacctgacaagtacgcgacaatttatgctgcgtcggtgcaaggcaggttcaccatctccagagatgattcagagaacacggcgtatctgcaaatgaacagcctgaaaaccgaggacacggccgtgtattactgtgccagacatccgtcgtattacgtatttttct

SEQ ID NO: 463999 - DNA, 415 bp, Homo sapiens; identical to SEQ ID NO: 444794
  misc_feature: HEFZJCU01D02Y2.14.74.G08.1.454.heavy.3.raw

SEQ ID NO: 464000 - DNA, 477 bp, Homo sapiens; identical to SEQ ID NO: 444659
  misc_feature: HEFZJCU01CVSAL.16.10.A10.1.454.heavy.3.raw

SEQ ID NO: 464001 - DNA, 528 bp, Homo sapiens
  misc_feature: HEFZJCU01BF6PN.53.33.C11.1.454.heavy.3.raw
cgcgtatacacacgaccggtgctcgatttagagtgagctcgttgggtttgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgaccctggggccagggaaccctggtcaccgtctcctcagcttccaccaagggcccatcggtcttccccctggcgccctgcctccgaggacgcacctcggtcggggcgacgagccggcccggtcgggtcgtcgtccgtggtacgaacggactacctttccctccgtac

SEQ ID NO: 464002 - DNA, 537 bp, Homo sapiens
  misc_feature: HEFZJCU01ERW32.4.33.C11.1.454.heavy.3.raw
agcactgtagcacgaccggtgctcgatttagagtgagctcgttgggtttgggggaggtgtgaggggacatgagtggtagaaacagtggatatgtgtggcagtgtctgaccttggtgtttttttgtttgtaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatgaacagcctgaagaccgaggacacagccgtctattactgtgttagggtagttttacgtatttttggtagtggtattagtttaactaacccctacctttcgtactacgtggggccgacgggtaacccgtggtcgccgttccg

SEQ ID NO: 464003 - DNA, 492 bp, Homo sapiens; identical to SEQ ID NO: 444695
  misc_feature: HEFZJCU01D8ZL8.3.34.D01.1.454.heavy.3.raw

SEQ ID NO: 464004 - DNA, 507 bp, Homo sapiens
  misc_feature: HEFZJCU01C9BG0.10.23.C01.1.454.heavy.3.raw
catagtagtgcacgaccggtgctcgatttagtacacgtgattagggattgggaggcttggtacagcctggcaggtccctgagactctcctgtgcagcctctggattcagctttgatgaatatgccatggactgggtccggcaagttccagggaagggcctggagtgggtctcaggtattgattggaatagtggtaccattgcctatgcggactctgtgaagggccgattcaccatcaccagagacgacgccaggagctccctgtatctccaaatgaacagtctgagacctgaggacacggccttgtattactgtgtaagagggagtcagggtttcaactattatagtagtggttatgactactggggccagggaaccctggtcaccgtctcctcagcctccaccaacgggcccatcggtcttcccctggccgccctgctccaggagcacctccgagagcacagcggcccgtgggctgcctggtcaaggactacttcccactactatg

SEQ ID NO: 464005 - DNA, 526 bp, Homo sapiens
  misc_feature: HEFZJCU01DBQ5A.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacggctgtttattactgtgcgcggtggctgaccgctcttgactactggggccggggagcccggtcatcgtctcc

SEQ ID NO: 464006 - DNA, 519 bp, Homo sapiens
  misc_feature: HEFZJCU01EMN5W.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagttggttccgccaggctccagggaaggggctggagtggctcgcacttatttacagtggcggcactacatactacacagacttcgcgaggggccgattcaccatctccagagacgattccaagaacacgttgtatcttcaaatgaacagcctgacagtcgacgacacggccatgtattttgtgcgagcgacccggggctcctcaatggctttcattactgggccagggaacctacg

SEQ ID NO: 464007 - DNA, 518 bp, Homo sapiens
  misc_feature: HEFZJCU01DC3QA.16.38.D05.1.454.heavy.3.raw
tgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtctgggggaggcgtggtccagcctggaaggtccctgagactctcgtgtgcagcgtctggattcatctttaatagttttcctatgcactggatccgccaggctccaggcaggggactggagtgggtggcaggagtgtcacttgatggagccaatacatacttcgcagactccgtgaagggccgattcaccatttccagagagaattccaacaacacgctgcatctgcaaatggacaccctgagacctgacgacacggctgtctattactgtgtgagactcttattgcgttcgggctttgactactggggccaggggatccctggtcaccgtctcctcagcctccaccaagggcccatcggtcttcccctcgg

SEQ ID NO: 464008 - DNA, 535 bp, Homo sapiens
  misc_feature: HEFZJCU01D5H0G.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgtccgttttattttgtacgagagcgtcgtctgtcagtggaattgactacgtggggccacgggaacctggtcaccgtctcctcagcctccaccgaacgg

SEQ ID NO: 464009 - DNA, 481 bp, Homo sapiens
  misc_feature: HEFZJCU01CFHL6.22.86.H09.1.454.heavy.3.raw
acatacgcgtcacgaccggtgctcgatttagtgctatagacttgagctctgggagaggagcccagcactagaagtcggcggtgtttccattcggtgatcagcactgaacacagaggactcaccatggagtttgggctgagcgtggttttctcgtagctctttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacgggcagtgtattactgtgcgagagatcgaca

SEQ ID NO: 464010 - DNA, 520 bp, Homo sapiens
  misc_feature: HEFZJCU01DJH9T.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtcgtggggccaagggaccc

SEQ ID NO: 464011 - DNA, 505 bp, Homo sapiens; identical to SEQ ID NO: 447076
  misc_feature: HEFZJCU01CL1QG.10.38.D05.1.454.heavy.3.raw

SEQ ID NO: 464012 - DNA, 501 bp, Homo sapiens; identical to SEQ ID NO: 453672
  misc_feature: HEFZJCU01A9YY4.40.81.H04.1.454.heavy.3.raw

SEQ ID NO: 464013 - DNA, 495 bp, Homo sapiens
  misc_feature: HEFZJCU01CMB0U.53.4.A04.1.454.heavy.3.raw
cgcgtatacacacgaccggtgctcgatttagagtagtgatcagggggctctgggagacgagcccagcactggaagtcgccggtgtttccattcggtgatcatcactgaacacagaggactcaccatggagtttgggctgagctgggttttcctcgttgctgttttaagaggtgtccagtgtcaggtgcatctggtggagtctgggggaggcgtggtccagcctggggggtccctgagactctcctgtgcagcctctggattcaccttcagtacctatcctattcactgggtccgccaggctccaggcaagggcctggagtgggtggcacttatatcatatgatggaggtgataaatactacgcagactccgtgaagggccgattcgccatctccagagacaattccaagaacaccctctatctacaaatgaagagaactgagacctgaggacacggctgtctattactgtgcgagagtcggctttagagatgcct

SEQ ID NO: 464014 - DNA, 491 bp, Homo sapiens; identical to SEQ ID NO: 447981
  misc_feature: HEFZJCU01A04I4.47.85.H08.1.454.heavy.3.raw

SEQ ID NO: 464015 - DNA, 498 bp, Homo sapiens; identical to SEQ ID NO: 445952
  misc_feature: HEFZJCU01AWCQQ.11.71.G05.1.454.heavy.3.raw

SEQ ID NO: 464016 - DNA, 498 bp, Homo sapiens
  misc_feature: HEFZJCU01EZKSJ.53.87.H10.1.454.heavy.3.raw
cgcgtatacacacgaccggtgctcgatttagcagtactgcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgacccctgggccagggaaccctggtcaccgtctcctcagcttccaccaaggcccatcggtcttccccc

SEQ ID NO: 464017 - DNA, 502 bp, Homo sapiens
  misc_feature: HEFZJCU01AE4OR.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagcgtgggttttccgtcgttagctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagatttctatagaaggtgactacgggggcgttcg

SEQ ID NO: 464018 - DNA, 523 bp, Homo sapiens
  misc_feature: HEFZJCU01CSDHR.40.20.B09.1.454.heavy.3.raw
tctagcgactcacgaccggtgctcgatttagtgtagtgtgaagggtctgagagaggagccttagccctggattccaaggcctatccacttggtgatcagcactgagcaccgaggagtcaccatggaactgggactccgctgggttttccttgttgcgattttagaaggtgtcaagtgtgaggtgcgactggtcgagtctgggggaggcctggtcaagccgggggggtccctgagactctcctgtgcagcctctggactcaccttcaggagtttcagtatgaattgggtccgccaggctccagggaagggctggagtgggtctcatccatcagcagtggtagcacttacatacactatgcagactcagtgaagggccgattcaccatctccagagacaacgccgggaactccctgtatctgcaaatgaagagcctgcgagccgaggacacgggtgtttattattgtactaaaggacaagagggactttgggagtactactacggtatggacgtcgtggggaccg

SEQ ID NO: 464019 - DNA, 519 bp, Homo sapiens; identical to SEQ ID NO: 445617
  misc_feature: HEFZJCU01BB80A.9.34.D01.1.454.heavy.3.raw

SEQ ID NO: 464020 - DNA, 374 bp, Homo sapiens; identical to SEQ ID NO: 444640
  misc_feature: HEFZJCU01BKO71.7.37.D04.1.454.heavy.3.raw

SEQ ID NO: 464021 - DNA, 394 bp, Homo sapiens
  misc_feature: HEFZJCU01BBML0.47.46.E02.1.454.heavy.3.raw
agctcacgtacacgaccggtgctcgatttagactcatctacagggaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctcctcagcctccaccaagggcccatcggtcttcccctggcgccctgctccaggagcacctccgagagcacagcggccctgggctgcctggtcaaggactacttcctacgtgagct

SEQ ID NO: 464022 - DNA, 519 bp, Homo sapiens
  misc_feature: HEFZJCU01C0GUI.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacccatgccttgacctgggtccgccaggctccaggggagggactggagtgggtcgcaggcatcgctggtggcggtcatgacacattctacgcaaactccgtggaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggccctgggctgcctggtcaaggactacttccagacgtatca

SEQ ID NO: 464023 - DNA, 512 bp, Homo sapiens
  misc_feature: HEFZJCU01A7CHQ.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctgggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgagggccgattcatcatctccagagacaacgccgacaactcactgtctctgctgatgagcagcctgagagccgacgacacggctatctattactgtgacgaaactctcattccgttcactctgaatactggggccagggaaccctggtccgtccg

SEQ ID NO: 464024 - DNA, 499 bp, Homo sapiens
  misc_feature: HEFZJCU01B5A9M.19.26.C04.1.454.heavy.3.raw
tactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccatttac

SEQ ID NO: 464025 - DNA, 495 bp, Homo sapiens
  misc_feature: HEFZJCU01BQYRA.10.29.C07.1.454.heavy.3.raw
catagtagtgcacgaccggtgctcgatttagagtgctacgaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccccgagactctcctgtgcagcctctggaatccccttcagtacctatggcatgcactgggtccgccaggctccaggcaaggggctggagtgggtggcagccatatcgtatgatgtaactaataaatactatgcagactccgtgaagggccgattcaccatctccagagacaatttcaagaacacgctgtttctgcaaatgaacagcctgagagctggagacacggctgtgtattactgtgcgaaagatatcgcggtgaccta

SEQ ID NO: 464026 - DNA, 483 bp, Homo sapiens; identical to SEQ ID NO: 453097
  misc_feature: HEFZJCU01DQG6I.19.71.G05.1.454.heavy.3.raw

SEQ ID NO: 464027 - DNA, 378 bp, Homo sapiens; identical to SEQ ID NO: 444419
  misc_feature: HEFZJCU01B41NW.47.77.G11.1.454.heavy.3.raw

SEQ ID NO: 464028 - DNA, 516 bp, Homo sapiens
  misc_feature: HEFZJCU01EEQ5A.48.19.B08.1.454.heavy.3.raw
agtatacatacacgaccggtgctcgatttagtgagtcagtaagggggatctcatgtgcaagaaaatgaagcacctgtggttcttcctcctcctggtggcggctcccagatgggtcctgtcccagctgcagctgcaggagtcgggcccaggactggtgaagccttcggagaccctgtccctcacctgcactgtctctggtgactccatcagcagtagtacttactactggggctggatccgccagcccccagggaaggggctggagtggattgggagtatctattatagtgggagtacctactacaacccgtccctcaagagtcgactcaccatatccgtagacacgtccaagaaccagttctccctgaagctgagctctgtgaccgccgcagacacggctgtgtattactgtgcggagggggccgggatattgttatagaaccacctgctatctgagctggttcactgctggggccagggaaccctggtcaccgtctccctcacgcctccaccgac

SEQ ID NO: 464029 - DNA, 509 bp, Homo sapiens
  misc_feature: HEFZJCU01DMIUC.51.21.B10.1.454.heavy.3.raw
cgatcgtatacacgaccggtgctcgatttagtgtcgtcgcaagggggcatcatccaacaaccacatcccttctctacagaagcctctgagaggaaagttcttcaccatggactggacctggagggtcttctgcttgctggctgtagctccaggtgctcactccctggtgcagctggtgcagtctggggctgaggtgaagaagcctggggcctcagtgacgatttcctgtaggacatctggatacacgttcaccggctattttatgtactgggtgcgacaggcccctggacaaggccttgagtggatgggaaagatcaaccctagtggtggtaccacaagttacgcccagaaattccagggcagagtctccatgaccagaaatacgtccgcgaggacagtctacatggagttgagcagcctgagaactgacgacacggccatatattactgtgcgagagaccttgctggtccttttgactttctggggccaggggaaccctggtcaccgt

SEQ ID NO: 464030 - DNA, 513 bp, Homo sapiens
  misc_feature: HEFZJCU01DPGH7.16.38.D05.1.454.heavy.3.raw
tgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtctgggggaggcgtggtccagcctggaaggtccctgagactctcgtgtgcagcgtctggattcatctttaatagttttcctatgcactggatccgccaggctccaggcaggggactggagtgggtggcaggagtgtcacttgatggagccaatacatacttcgcagactccgtgaagggccgattcaccatttccagagagaattccaacaacacgctgcatctgcaaatggacaccctgagacctgacgacacggctgtctattactgtgtgagactcttattgcgttcgggctttgactactggggccagggatcctggtcaccgtctcctcagcctcaccaagggcccatcggtcttcccctc

SEQ ID NO: 464031 - DNA, 500 bp, Homo sapiens
  misc_feature: HEFZJCU01CRT83.48.87.H10.1.454.heavy.3.raw
agtatacatacacgaccggtgctcgatttagcagtactgcgttgggtttgggggctctcagagaggtgccttagccctggattccaaggcatttccacctggtgatcagcactgaacacagaggactcaccatggaggtggggctgtgctgggtgttccttgttgctattttagaaggtgtccaatgtgaggtgcagctggtggaatctggggtgccttggtgccgccggggggtccctgagactctcctgtgtagcctccggattcacatttagttcccatagtatggtctcgggtccgccaggctccagggaagggtctagagtggatttcatacattaggagtggcagtagtcccatatactacgcagactctgtgaagggccgattcatcatctccagagacaatgccgagaactcactgtttctgcaaatgaacagcctgagagacgaggacacggctgtttattactgtgcgagagtgcggatttcactacaca

SEQ ID NO: 464032 - DNA, 491 bp, Homo sapiens
  misc_feature: HEFZJCU01BB2QC.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtggggtggcgattatatcacatgatggaactaatagacgctatgccgactccgtgaagggccgattcaccatctccagagacaattccaagacacgcagtatctgcaaatgaacagcctgagagctgaggcacggctgtgtattactgtgggagagatggaggtcgatattgt

SEQ ID NO: 464033 - DNA, 523 bp, Homo sapiens
  misc_feature: HEFZJCU01CKUED.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttccgaccctgggccagggaacccaggtcaccgtctcctcacgcctccaccaagggcccatccgtccttccccctcggccgccctgctccaggagcacctccgagagcacagcgccctgggctgcctggtcaggactacttcctacg

SEQ ID NO: 464034 - DNA, 510 bp, Homo sapiens; identical to SEQ ID NO: 447226
  misc_feature: HEFZJCU01DKFTA.12.78.H01.1.454.heavy.3.raw

SEQ ID NO: 464035 - DNA, 497 bp, Homo sapiens; identical to SEQ ID NO: 459218
  misc_feature: HEFZJCU01COPGK.4.75.G09.1.454.heavy.3.raw

SEQ ID NO: 464036 - DNA, 506 bp, Homo sapiens
  misc_feature: HEFZJCU01ERVA0.48.28.C06.1.454.heavy.3.raw
  modified_base (456)..(456): a, c, t, g, unknown or other
agtatacatacacgaccggtgctcgatttagagctcacgtattgggtttggggctgagctgggttttccttgttgccatattagaaggtgtccactgtgaggtgcagctggcggagtctgggggagacttggtacagcctggggagtccctgagactctcctgtgcagcctctggattcaccttcagtttgtttgacatgcactgggtccgccaggctccaggaaaaggtctggagtgggtctcagtcatgggtacagctggtcacacatactatgcagactccgtaaagggccgattcaccatctccagagaagacgccaagaattccttgtatcttcagatgaacagtctgagaaccgatgacacggctgtgtattattgtgcaaaagggggagcagctcgtccatccacttcgactcctggggccagggaaccctggtcaccgtctcctcacncgtccaccaacggaccgactcgtcgttccctccgcgccctccctccacga

SEQ ID NO: 464037 - DNA, 506 bp, Homo sapiens; identical to SEQ ID NO: 446520
  misc_feature: HEFZJCU01AZ4CW.10.38.D05.1.454.heavy.3.raw

SEQ ID NO: 464038 - DNA, 512 bp, Homo sapiens; identical to SEQ ID NO: 445279
  misc_feature: HEFZJCU01CVZVE.17.33.C11.1.454.heavy.3.raw

SEQ ID NO: 464039 - DNA, 497 bp, Homo sapiens
  misc_feature: HEFZJCU01CQSXB.53.80.H03.1.454.heavy.3.raw
cgcgtatacacacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctgggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacacgtccatcagcactgcctacatggagctgaccaggctgaaatttgaggacacggccatttattactgtgcaaggaacagcataatgactcgtccccggactttacg

SEQ ID NO: 464040 - DNA, 525 bp, Homo sapiens; identical to SEQ ID NO: 457158
  misc_feature: HEFZJCU01D6FZ0.9.78.H01.1.454.heavy.3.raw

SEQ ID NO: 464041 - DNA, 502 bp, Homo sapiens
  misc_feature: HEFZJCU01EXHT2.10.38.D05.1.454.heavy.3.raw
catagtagtgcacgaccggtgctcgatttagtatctgatagttgggtttgggtgccgaagttgctggaggtcacggtcaccacgctgctgagggagtagggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacgaccacctattattgtgcgcgacatgactacgctcaattctggggccagggagcccaggtcaccgtctccccagcctccaccaagggcccatcggtcttccccctggcgccctgctccaggagcacctccgagagcacagcggccctgggctgcctggtcaaggactacttcccactact

SEQ ID NO: 464042 - DNA, 517 bp, Homo sapiens; identical to SEQ ID NO: 446608
  misc_feature: HEFZJCU01B7E8A.9.34.D01.1.454.heavy.3.raw

SEQ ID NO: 464043 - DNA, 390 bp, Homo sapiens
  misc_feature: HEFZJCU01D9MGJ.22.29.C07.1.454.heavy.3.raw
acatacgcgtcacgaccggtgctcgatttagagtgctacgaagggaaaggggctggagtgggtctcaggtattagtgataatgcttttagcacaaactacgcagactccgtgaagggccggttcaccatctccagagacaattccaagaacacgctgtatttgcaaatgaacagcctgagagccgaagacacggccgtctattactgtgcgagattaccgcatacggtgactacctactttctcgactggggccagggaaccctggtcaccgtctcctcagcctccaccaagggcccatcggtcttccccctggcgccctgctccaggagcacctccgagagcacagcggccctgggctgcctggtcaaggactacttccacgcgtatgt

SEQ ID NO: 464044 - DNA, 501 bp, Homo sapiens
  misc_feature: HEFZJCU01EE71K.51.43.D10.1.454.heavy.3.raw
cgatcgtatacacgaccggtgctcgatttagactagcagtaagggggagcatcacccagcaaccacattctgtcctctagagaatcccctgagagctccgttcctcaccatggactggacctggaggatcctcttcttggtggcagcagccacaggagcccactcccaggtgcagctggtgcagtccgggggtgaagtgaagaagcctggggcctcagtgaaggtctcctgcagggcctctggatacaccttcaccggctattatatccactgggtgcgacaggcccctggacaagggcttgagtggatgggatggatgaagcccaatagtggtgccacaaagacagcacagaagtttcagggcagggtcaccatgaccagggagacgtccgtcaggacagcctatatggaggtgaccagcctgagccctgacgacacggccatatatttctgtgcgcgaggatttcgacttctggaataattacttgggttagaactatt

SEQ ID NO: 464045 - DNA, 499 bp, Homo sapiens; identical to SEQ ID NO: 447461
  misc_feature: HEFZJCU01ETU2N.3.20.B09.1.454.heavy.3.raw

SEQ ID NO: 464046 - DNA, 323 bp, Homo sapiens
  misc_feature: HEFZJCU01B09YG.22.29.C07.1.454.heavy.3.raw
acatacgcgtcacgaccggtgctcgatttagagtgctacgaagggaaagggccggttcaccatctccagagacaattccaagaacacgctgtatttgcaaatgaacagcctgagagccgaagacacggccgtctattactgtgcgagattaccgcatacggtgactacctactttctcgactggggccagggaaccctggtcaccgtctcctcagcctccaccaagggcccatcggtcttccccctggcaccctcctccaagagcacctctggggcacagcggccctgggctgcctggtcaaggactacttccagacgtatca

SEQ ID NO: 464047 - DNA, 522 bp, Homo sapiens
  misc_feature: HEFZJCU01CC1O0.13.36.D03.1.454.heavy.3.raw
  modified_base (434)..(434): a, c, t, g, unknown or other
tcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaatggggcgcagggctgttgaagccttcggagaccctgtccctcacgtgcgctgtctctggtggttcttcagtggttactactggagctggatccgccagtccccagggaaggggctggagtggattggggaaatcaatcatagtggaagcaccaactacaacccgtccctcgagagccgagtcaccatgtcagtagacacgtccaagaaccagttctccctgagggtgagctctgtgaccgccgcggacacggctgtntacttctgtgcgagagggcaatttttgggactcggtcatttctccctttgactttctgggggtccaggggaaccctagtcaccgttcg

SEQ ID NO: 464048 - DNA, 505 bp, Homo sapiens
  misc_feature: HEFZJCU01EELDU.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaagacgtatgtagtggtgactgcttgtttggagcttttgactactggggccagggaaccctgggtcatcgtctcctcagcctccaccaagggcccatcggtcttcccctggcaccctcctccaagagcacctctgggggcacagcgccctgggctgcctggtcaaggactacttccgagtagtaca

SEQ ID NO: 464049 - DNA, 498 bp, Homo sapiens
  misc_feature: HEFZJCU01DK1BZ.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgttctgcaatgaacagcctgagaattgaggactcgggtatatactactgtgcccgtgacccctgactgataaccggactggttcgaccctggggccgagggaaccctggtcaccgtctcctcc

SEQ ID NO: 464050 - DNA, 482 bp, Homo sapiens; identical to SEQ ID NO: 444904
  misc_feature: HEFZJCU01BLZSM.47.59.F04.1.454.heavy.3.raw

SEQ ID NO: 464051 - DNA, 497 bp, Homo sapiens
  misc_feature: HEFZJCU01DSAA5.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcaggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagatttctatagaggtgactacgggggcgttcg

SEQ ID NO: 464052 - DNA, 506 bp, Homo sapiens
  misc_feature: HEFZJCU01ES6B8.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcaggccggcctttgactttctc

SEQ ID NO: 464053 - DNA, 379 bp, Homo sapiens; identical to SEQ ID NO: 444450
  misc_feature: HEFZJCU01CFH97.47.77.G11.1.454.heavy.3.raw

SEQ ID NO: 464054 - DNA, 510 bp, Homo sapiens
  misc_feature: HEFZJCU01AQ8TE.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctggggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaggcagattcatcatctcaagagatgattccaacgcatcgcctatctgcagatgaacagcctgaagaccgaggacacagccgtctattactgtgttagggagttttacgtatttttggta

SEQ ID NO: 464055 - DNA, 508 bp, Homo sapiens
  misc_feature: HEFZJCU01DFU7K.49.27.C05.1.454.heavy.3.raw
agtcgagagacacgaccggtgctcgatttagacgcgatcgaagggtttgggctgagcgtgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctgaagacacggctgtatattactgtgcgaacttaatcacggaggacaacggtgacccccgtccgctcggtgcggaggtcgtgggggccaagggaccacggtcatcgtctcctcagcctccaccaagggcccatcggtcttccccctgg

SEQ ID NO: 464056 - DNA, 518 bp, Homo sapiens
  misc_feature: HEFZJCU01DKGLB.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggaggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaaacagcctagagaaccgacgacacggccgtctattattgtgtcatagacctaggatacaacgacggtggtacctggtatc

SEQ ID NO: 464057 - DNA, 514 bp, Homo sapiens
  misc_feature: HEFZJCU01AYJ73.17.42.D09.1.454.heavy.3.raw
cgtagactagcacgaccggtgctcgatttagacacatacgcagggaaaggggtgggcggcaactatgcaaatgcaagtgggggcctctccacttaaacccagggctcccctccacagtgagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcacctgggtgcgccagaagcccggtaaaggcctggagtggatggggaggattgatcccagtgactctcacatcaactacagcccgtccttccaaggccacgtcaccatctcagctgacaagtccatcagtactgccttcctgcagtggcgcagcctggaggcctcggacaccgccatata

SEQ ID NO: 464058 - DNA, 503 bp, Homo sapiens; identical to SEQ ID NO: 445995
  misc_feature: HEFZJCU01B3V81.17.25.C03.1.454.heavy.3.raw

SEQ ID NO: 464059 - DNA, 503 bp, Homo sapiens
  misc_feature: HEFZJCU01BH4CA.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctgctccaggagcacctctggggc

SEQ ID NO: 464060 - DNA, 510 bp, Homo sapiens
  misc_feature: HEFZJCU01ENJ2J.53.77.G11.1.454.heavy.3.raw
cgcgtatacacacgaccggtgctcgatttagctagtcactcaagggaaaggggtcggtgatcagcactgaacacagaggactcaccatggagtttgggctgagctgggttttcctcgttgctcttttaagaggtgtccagtgtcaggtgcacctagtggagtctgggggaggcgtcgtccaccctggggggtccctgagactctcctgtgcagcctctggattcaccttcagagtctatggcatgcactgggtccgccaggctccaggcaaggggctggagtgggtggcacttatatcagatgatggaagtgatacatactatggagactccgtgaagggccgattcaccatctcgagagacaattccaggaacacgctgtatctgcaaatgaacggcctgagagctgaggacacggctgtgtattactgtgcgaaacggttgagtgggaattaggggctgagtacggtatggacgtcgtggggccgaagggaccacggtcaccgtctcc

SEQ ID NO: 464061 - DNA, 517 bp, Homo sapiens
  misc_feature: HEFZJCU01EKQD5.52.75.G09.1.454.heavy.3.raw
cgcagtacgacacgaccggtgctcgatttagtatagacatcagggggctctgagagaggagcccagccctgggattttcaggtgttttcatttggtgatcaggactgaacagagagaactcaccatggagtttgggctgagctggcttttcttgtggctattttaaaaggtgtccatggtgaggtgcggctgttggaatccggggggggcttgatacagcctggggggtccctgagactctcctgtgctgcctctggattcagtttcagtgacttagccatgagctgggtccgccaggctccagggaaggggctggaatgggtctcagtcgttactgctggacttactaccacatactacgcagactccgtgaagggccggttcgccatctccagagacaattccaagaataccctatatctgcaaatgagcagcctgagagccgaggacacggccgtatattactgtgcgatgggaagtagtggttactactactactttgacaactggggccaac

SEQ ID NO: 464062 - DNA, 500 bp, Homo sapiens
  misc_feature: HEFZJCU01B8708.19.26.C04.1.454.heavy.3.raw
tactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaatgaacagcctgagagctggggacacggctgtgtattactgtgcgagagcggcgtggcaactacactccatttac

SEQ ID NO: 464063 - DNA, 496 bp, Homo sapiens
  misc_feature: HEFZJCU01B3RB1.48.59.F04.1.454.heavy.3.raw
  modified_base (477)..(477): a, c, t, g, unknown or other
agtatacatacacgaccggtgctcgatttagtacacacacttagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaaagtcgaggcaccatatccgtagacacgtccaagaaccaattctccctgaagctgagctctgtgaccgccgcagacacggctgtctattactgtgcgaggccccgagcgcagtggctttttgatgcctttgntatgtgggccaaggacaat

SEQ ID NO: 464064 - DNA, 500 bp, Homo sapiens; identical to SEQ ID NO: 450218
  misc_feature: HEFZJCU01BNN7T.17.10.A10.1.454.heavy.3.raw

SEQ ID NO: 464065 - DNA, 521 bp, Homo sapiens
  misc_feature: HEFZJCU01B222F.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgtggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctagttaaaactcctactacggtctggacgtcgtggggccaggggacctaac

SEQ ID NO: 464066 - DNA, 323 bp, Homo sapiens
  misc_feature: HEFZJCU01A98HA.4.19.B08.1.454.heavy.3.raw
agcactgtagcacgaccggtgctcgatttagtgagtcagtaagggtcgattcaccatctccagagacaatcgcaagaacacactgtatctggaaatgaccagcctgagaggtgacgacacgggtgtttattactgtgcgcgggatagaggctcatcgtggatacaactatggtttgattactggggccacggaaccctggtcaccgtctcttcagcttccaccaagggcccatcggtcttcccctggcgccctgctccaggagcacctctgggggcacagcggccctgggctgcctggtcaaggactacttccctacagtgct

SEQ ID NO: 464067 - DNA, 540 bp, Homo sapiens
  misc_feature: HEFZJCU01A7X64.48.53.E09.1.454.heavy.3.raw
agtatacatacacgaccggtgctcgatttagagagagtgtgttgggtttggggacttttccaatttttttgggggccagcgctgggtctcttgccaagagaaccccggagtagttgggggggctcaggaacctgccctaagacaacagcgtccacacagacgaggggctacgggtcctcacagacgaagggcacggggtccagatgatccctcctcctggccccgccacctcgtctctttctgcggccaggcgcactctgggcctctggggtcaagtggccggcaaccccgggcctccccggcctctgtctcagagagtcccagggacgtggcggggcgccggttcttccctggggtcctggcgttgttgtcaccttgtgtcacctgtttcgacccctgggcccagggagccctggtcaccgtctccttagcctccaccaagggcccatcggtcttccccctggcgccctgctccaggagcacctccgagagcacagcggccctgggctgcctggtcaaggactacttcctatgtatact

SEQ ID NO: 464068 - DNA, 527 bp, Homo sapiens
  misc_feature: HEFZJCU01DTMU0.18.78.H01.1.454.heavy.3.raw
tacgagtatgcacgaccggtgctcgatttagtgtgagtagtttgggtttggggctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggagtctgggggaggcttggtaaagccggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacactccctgaaagcgtcaactactactactacggtatggacctc

SEQ ID NO: 464069 - DNA, 506 bp, Homo sapiens
  misc_feature: HEFZJCU01BAZVL.47.56.F01.1.454.heavy.3.raw
agctcacgtacacgaccggtgctcgatttagcagacgtctgaacacacaaagggggccccagccctgggattcccagctgtttctgcttgctgatcaggactgcacacagagaactcaccatggagtttgggctgagctgggttttccttgttgctattttaaaaggtgtccagtgtgaggtgcaactggtggagtccgggggaggcttaattcagcctggggggtccctgagactctcctgtgcagcctctggattcaccttcagtagttactggatgcactgggtccgccaagctccagggaagggactggtgtgggtctcacgtattaatcctgatggaagtcgcacaaactacgcggactccgtgagggaccgattcaccatctccagagacaacgccaagaacacgctgtatctgcaaatgcacagtctgagagccgacgatgcggctgtatatttctgtgcaagagatcaactggtgggaccgactttatttcaggtctc

SEQ ID NO: 464070 - DNA, 516 bp, Homo sapiens
  misc_feature: HEFZJCU01EQYVW.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctgggccaaggtacagcggtcaccgtcgcctcagcctccaccaaggcccatcggtcttcccctggcaccctcctccagagcacctctgggggcacac

SEQ ID NO: 464071 - DNA, 489 bp, Homo sapiens; identical to SEQ ID NO: 444791
  misc_feature: HEFZJCU01EGA2Y.47.85.H08.1.454.heavy.3.raw

SEQ ID NO: 464072 - DNA, 498 bp, Homo sapiens
  misc_feature: HEFZJCU01DBQAB.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggtaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaaggcccatcggtccttcccctgccgcctgct

SEQ ID NO: 464073 - DNA, 396 bp, Homo sapiens
  misc_feature: HEFZJCU01A5BMN.47.59.F04.1.454.heavy.3.raw
agctcacgtacacgaccggtgctcgatttagtacacacacttagggagggggctggagtggatttcatacattggtgttaggagtaacatcatacactatgcagactctgtgaagggccgattcaccgtttcccgagacgatgccaaaaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggcccatcggtcttccccctggcgccctgctccaggagcacctccgagagcacagcggccctgggctgcctggtcaaggactacttcctacgtgagct

SEQ ID NO: 464074 - DNA, 503 bp, Homo sapiens
  misc_feature: HEFZJCU01C82J8.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgtttcatctgaaggagtgttcaatactatacagactccgtgaagggccgattcaccatctccagagacaattccaagaacacgatgtatctgcaaatggacagcctaagagttgaggacacggctgtttattactgtacgaagagggggagtacagtgcagctccaagtactta

SEQ ID NO: 464075 - DNA, 527 bp, Homo sapiens
  misc_feature: HEFZJCU01BTZZE.18.59.F04.1.454.heavy.3.raw
tacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatcccctgaaagcgtcaactactactactacggtatggacctct

SEQ ID NO: 464076 - DNA, 507 bp, Homo sapiens; identical to SEQ ID NO: 449116
  misc_feature: HEFZJCU01B76N7.48.44.D11.1.454.heavy.3.raw

SEQ ID NO: 464077 - DNA, 513 bp, Homo sapiens
  misc_feature: HEFZJCU01EZA5P.3.71.G05.1.454.heavy.3.raw
agacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggattttccttttggctattttaaaaggtgtccggtgtgaagtgcaactggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtgataacatcggctatgcggactctgtgaagggccgattcaccatctccagagacaacgccaagaactccctgtatctgcaaatgaacagtctgagacctgacggacacggccttgtattactgtgtaaaggtcccggggaaatatgtacgatttttac

SEQ ID NO: 464078 - DNA, 535 bp, Homo sapiens
  misc_feature: HEFZJCU01EB4Z9.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaatgaacagcctgagaaccgaggacacagccgtgtattactgtaccacatccctgaaagcgtcaactactaactactacggtatggacctctggggaccg

SEQ ID NO: 464079 - DNA, 514 bp, Homo sapiens
  misc_feature: HEFZJCU01BDWE2.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgttcatctgaaggaagtgttcaatactatacagactccgtgaagggccgattcaccatctccagagacaattccaagaacacgatgtatctgcaaatggacagcctaagagttggaggacgacggctgtttattactgtacgaaaggaggggggagtacgagtaggcagctccaacgtacttacg

SEQ ID NO: 464080 - DNA, 513 bp, Homo sapiens
  misc_feature: HEFZJCU01AOR6D.52.86.H09.1.454.heavy.3.raw
cgcagtacgacacgaccggtgctcgatttagtgctatagacttgggtttgggctgagcgtgggttttcctcgttgctcttttaagaggcgtccagtgtcaggtgcagctggtggagtctgggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgattatctggggccaagggacaatggtcattgtctctttcagccctccaccaagggcccatcggtctttcccccg

SEQ ID NO: 464081 - DNA, 522 bp, Homo sapiens
  misc_feature: HEFZJCU01BMSE6.22.65.F10.1.454.heavy.3.raw
acatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtctgggggaggcttggtcaagcctggagggtccctgagactctcctgtgcagcctctggattccccttcagtgacttctacatgaattggatccgccaggctccagggaaggggctggagtgggtttcatacattagtggtagtggtatttttaaatacgcagactctgtgaagggccgattcaccatctccagggacaacgccaagaactcactgtatctgcaaatgaacagcctgagagtcgaggacacggccgtgtattattgtgcgggaagaggatcggggcagttatgctttcgaccctggggccagggaaccctc

SEQ ID NO: 464082 - DNA, 515 bp, Homo sapiens
  misc_feature: HEFZJCU01D4DZQ.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaatacgattttcgatccctccgcagtcgacactttgattactggggccgggaacctggtcgccgtctcctcagcctccaccaagggcccatcggtcttcccctggcaccctcctccaagagcacctctgggggcacagcggccctgggctgcctggtcaaggactactcctagacgtatca

SEQ ID NO: 464083 - DNA, 515 bp, Homo sapiens
  misc_feature: HEFZJCU01DSD5R.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccagcgggagtccaagtactcc

SEQ ID NO: 464084 - DNA, 395 bp, Homo sapiens; identical to SEQ ID NO: 444517
  misc_feature: HEFZJCU01BB5XI.16.68.G02.1.454.heavy.3.raw

SEQ ID NO: 464085 - DNA, 515 bp, Homo sapiens
  misc_feature: HEFZJCU01AG9W7.49.6.A06.1.454.heavy.3.raw
agtcgagagacacgaccggtgctcgatttagatctactgacaggggtctgagagaggagcccagccctgggattttcaggtgttttcatttggtgatcaggactgagcagagagaactcaccatggagtttgggctgagctggctttttcttgtggctattttaaaaggtgtccagtgtgaggtgcagctggtggactctgggggaggcttggtacagcctggggggtccctgagactctcctgtgcagcctctggattcacctttagcagttttgccatgggctgggtccgccaggctccagggaaggggctggagtgggtctcaactattagcggtattggtactaccacatactacgcagactccgtgaagggccgcttcaccatctccagagacaattccaagaacatggtgtttctgcaaatgagcagcctgagagccgaggacacggccgtatattactgtgcgaagttcgcgtgctaggtacatttgactactggggccagggaaacc

SEQ ID NO: 464086 - DNA, 487 bp, Homo sapiens; identical to SEQ ID NO: 450070
  misc_feature: HEFZJCU01EBAF0.47.55.E11.1.454.heavy.3.raw

SEQ ID NO: 464087 - DNA, 492 bp, Homo sapiens
  misc_feature: HEFZJCU01CAKDH.13.71.G05.1.454.heavy.3.raw
tcacgtactacacgaccggtgctcgatttagtgtcgtcgcaagagagaggaggccagcactaggagtcggtggtgtttccattcggtgatcagcagtgaacacagaggactcaccatggagtttgggctgagctgggttttcctcgttgctcttttaagaggtgtccagtgtcaggtgcagctggtggaatctgggggaggcgtggtccagcctggggaatccctgacactgtcttgtgtagcctctggattcagcttcagaacctatggcatgcactgggtccgccaggccccaggcaaggggctggagtggctgactcttttatcatatgatggaagtcaaaaattctatgcagactccgtgaagggccgattcaccgtctccagggacaactccaagaacaccttatatctgcagatgaacagcctgagaggtgacgactcggctgtatacttctgtgcgacaaacatgatgtttggagtggatgtgta

SEQ ID NO: 464088 - DNA, 469 bp, Homo sapiens; identical to SEQ ID NO: 445536
  misc_feature: HEFZJCU01C4H64.48.51.E07.1.454.heavy.3.raw

SEQ ID NO: 464089 - DNA, 506 bp, Homo sapiens
  misc_feature: HEFZJCU01C32CP.3.26.C04.1.454.heavy.3.raw
  modified_base (377)..(377): a, c, t, g, unknown or other
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgnggcaccctgctgactgtctcctcagcctccaccaagggcccatcggtcttcccctggcgccctgctccaggagcaccctccgagagcacacgcgggccctggggctgcctgggtcaagggaccttaccg

SEQ ID NO: 464090 - DNA, 533 bp, Homo sapiens; identical to SEQ ID NO: 446098
  misc_feature: HEFZJCU01BH1XL.7.78.H01.1.454.heavy.3.raw

SEQ ID NO: 464091 - DNA, 538 bp, Homo sapiens
  misc_feature: HEFZJCU01B3Y7I.48.27.C05.1.454.heavy.3.raw
agtatacatacacgaccggtgctcgatttagacgcgatcgaagggtttgggggggagaggagcccagcactgggattccgaggtgtttccattcggtgatcagcactgaacacagaggactcaccatggagttttggctgaggtgtccagtgtgaggtgtagctggtggagtctggaggaggcttgccccagcctgggaggtccctaagactttcctgtgcagcctctgggtttagtgtcactagtaggaagatgacttgggtccaccaggctccagggaaggggctggagcgggtcgcaattctttacagtggtgttaggacaacctacgcagactccgtgaaggggcgattcaccttctccagaggcaattccaagaacaccctgtgtcttcgtggtctcatttctttatagcggtgttaggacaacctacgcagactccgtgaaggggcgattcaccttctccagaggcaattccaagaacaccctgtatcttcaaataaacagtctaagagccgaggacacggccctgtcgtac

SEQ ID NO: 464092 - DNA, 499 bp, Homo sapiens; identical to SEQ ID NO: 453198
  misc_feature: HEFZJCU01EN9J2.11.71.G05.1.454.heavy.3.raw

SEQ ID NO: 464093 - DNA, 313 bp, Homo sapiens; identical to SEQ ID NO: 444518
  misc_feature: HEFZJCU01BUNVU.7.10.A10.1.454.heavy.3.raw

SEQ ID NO: 464094 - DNA, 521 bp, Homo sapiens
  misc_feature: HEFZJCU01DHFUL.12.40.D07.1.454.heavy.3.raw
atacgacgtacacgaccggtgctcgatttagtgatagagcgtaacaacagagggctcaccatggagtttgggctgagcgtggtttcgtcgtaggctctttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttccccctggcg

SEQ ID NO: 464095 - DNA, 499 bp, Homo sapiens
  misc_feature: HEFZJCU01DN8TG.16.71.G05.1.454.heavy.3.raw
  modified_base (459)..(459): a, c, t, g, unknown or other
tgtactactccacgaccggtgctcgatttagtgtcgtcgcaagagagaggagcccagccctgggattttcaggtgttttcatttggtgatcaggactgaacagagagaactcaccatggagtctgggctgagcgtgcgtttctaggtcggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttatccacatactacgcagactccgtgaagggccggttcaccatctccagagacaattccaagaacaccatgtatctgacaatgaacagcctgagagccgacgacacgccatatatactgtncgaaagcaccggcagttagtcacccatactactttgaact

SEQ ID NO: 464096 - DNA, 520 bp, Homo sapiens
  misc_feature: HEFZJCU01EJ1RN.21.27.C05.1.454.heavy.3.raw
tcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggttggaattggattaggcagtccccgtcgagaggccttgagtggcttggaaggacctattatacgtcccagtggtatgaagactatgcagattctgtgagcggtcgtctcaccatcaccccagacacgtccaagaatcaggtctccctccacctaatgtctgtcactcccgacgacacggctagtttatttttgtgcaagagggatcactattcggtgacctacctccttgactccgtcggggccgaagggtaacg

SEQ ID NO: 464097 - DNA, 545 bp, Homo sapiens
  misc_feature: HEFZJCU01D5Q18.15.86.H09.1.454.heavy.3.raw
tctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaaagtaaaatgatggtgagaaaatagactacggtgcacccgtgaaaggaagattcaccatctcaagagataattcaaaaacgacggtgtatttgcaaatgaacagcctgaaaaccgaggacacagccgtctattactgtaccacagattcggaagtgcatcgacgtaaaggaggctatgcttttgatatctggggcccaggggacaa

SEQ ID NO: 464098 - DNA, 508 bp, Homo sapiens
  misc_feature: HEFZJCU01ARAL6.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgccctgctccaggagcacctctgggggcacagcggccctgggctgcctggtcaaggactactccca

SEQ ID NO: 464099 - DNA, 505 bp, Homo sapiens
  misc_feature: HEFZJCU01BC99G.40.31.C09.1.454.heavy.3.raw
tctagcgactcacgaccggtgctcgatttagacgtctcatcaaggaaggaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtgggcaagggacaatggtcaccgtctcttcagcctccaccaac

SEQ ID NO: 464100 - DNA, 518 bp, Homo sapiens; identical to SEQ ID NO: 444718
  misc_feature: HEFZJCU01CICV0.9.34.D01.1.454.heavy.3.raw

SEQ ID NO: 464101 - DNA, 521 bp, Homo sapiens
  misc_feature: HEFZJCU01BTE9J.53.57.F02.1.454.heavy.3.raw
  modified_base (461)..(461): a, c, t, g, unknown or other
cgcgtatacacacgaccggtgctcgatttagctcgatatagttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctggattcaccttcagggtctatgacatgcactgggtccgccaggctccaggcaaggggctggagtgggtggcagttatatcaaatgatggaagtaagaaatactatgtagactccgtgaagggccgattcaccatctccagagacaattccaagaatacgctgtatctgcacatgaacagcctgagagccgaagacacggggtntttattactgtgcgaacttaattacggagacaacggtaaccccgtcgcacggtacgtacg

SEQ ID NO: 464102 - DNA, 486 bp, Homo sapiens; identical to SEQ ID NO: 444861
  misc_feature: HEFZJCU01DGX0C.47.55.E11.1.454.heavy.3.raw

SEQ ID NO: 464103 - DNA, 505 bp, Homo sapiens
  misc_feature: HEFZJCU01B6E60.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgatgacacggccgtctattactgtgcgagagccgcgaatatgtggtgcaaagatggtcgttgtttgtttggccggtgaactactgggccagggcaccctggtcaccgtctcctcagcttccaccaagggcccatcggtcttcccctggcgcctcgctccaggagcacctcgtggggcacagcggccctggctgcctggtcaaggactactccta

SEQ ID NO: 464104 - DNA, 500 bp, Homo sapiens
  misc_feature: HEFZJCU01AM1PI.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgacttc

SEQ ID NO: 464105 - DNA, 511 bp, Homo sapiens
  misc_feature: HEFZJCU01EURJT.48.53.E09.1.454.heavy.3.raw
agtatacatacacgaccggtgctcgatttagagagagtgtgttgggtcgggggggagggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactacttcctatgtatact

SEQ ID NO: 464106 - DNA, 504 bp, Homo sapiens
  misc_feature: HEFZJCU01ED6H2.13.33.C11.1.454.heavy.3.raw
tcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaataagaattgcaaacgatgcttttgatatgtggggccaagggactaac

SEQ ID NO: 464107 - DNA, 471 bp, Homo sapiens
  misc_feature: HEFZJCU01A35ZZ.15.1.A01.1.454.heavy.3.raw
tctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgtgaagggcagattcaccatctccagagacaatttggagaacaccgtgattcttaatatgaacagcctgagagccgatgacacggctgtgtatttctgtgcgagagacgggtataatagttactggtttggccactggggccagggaaccctggtcatcgtctcgtcagcctccaccaagggcccatcggtcttccccctggcaccctcctccaagagcacctctgggggcacagcggccctgggctgcctggtcaaggactacttccgctacgtaga

SEQ ID NO: 464108 - DNA, 521 bp, Homo sapiens
  misc_feature: HEFZJCU01CVF5M.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctagtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttcctcctgacagtgagttatatgaccgccgcagacacggccgtgtattactgtgcgagagaggccgttattttaggaccagctgttaaaaactccttactacggtctggacgtctggggccaggggaccaaac

SEQ ID NO: 464109 - DNA, 492 bp, Homo sapiens
  misc_feature: HEFZJCU01A8AJ9.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccac

SEQ ID NO: 464110 - DNA, 512 bp, Homo sapiens
  misc_feature: HEFZJCU01DA9NM.48.34.D01.1.454.heavy.3.raw
agtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggccgccctgctccaggacgcacctccgagagcacagcggccctgggcctgcctggtcaaggactac

SEQ ID NO: 464111 - DNA, 492 bp, Homo sapiens; identical to SEQ ID NO: 444827
  misc_feature: HEFZJCU01A3DW4.4.28.C06.1.454.heavy.3.raw

SEQ ID NO: 464112 - DNA, 529 bp, Homo sapiens
  misc_feature: HEFZJCU01CAJKF.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactatacatgctcctttttacaccttcccttgacttctggggccagtcggaacccggtcg

SEQ ID NO: 464113 - DNA, 395 bp, Homo sapiens; identical to SEQ ID NO: 445547
  misc_feature: HEFZJCU01DZMUT.18.31.C09.1.454.heavy.3.raw

SEQ ID NO: 464114 - DNA, 511 bp, Homo sapiens
  misc_feature: HEFZJCU01EKKKB.48.53.E09.1.454.heavy.3.raw
agtatacatacacgaccggtgctcgatttagagagagtgtgttgggtttggggatgctttctgagagtcatggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactgggcctggatccgccagccccccgggaagggactggaatggattgggagtatctattatacagggagcacctactacaacccgtccctcaagagtcgagtcaccatctccgcagacacgtccaagaaccagttctccctgaggctgagctctgtgaccgccgcagacacggctgtctattactgtgcgagaagtgggtcgtggcagtggctggtacgtggctctcagtggttcgaccctggggccaggggataccgtc

SEQ ID NO: 464115 - DNA, 509 bp, Homo sapiens
  misc_feature: HEFZJCU01DWYAL.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttccccctggccgcctcgctccaggagcacctccgagagcacagccggccctgggctgcctggtcaaggactactttcccactacta

SEQ ID NO: 464116 - DNA, 497 bp, Homo sapiens; identical to SEQ ID NO: 450948
  misc_feature: HEFZJCU01A8M6W.53.80.H03.1.454.heavy.3.raw

SEQ ID NO: 464117 - DNA, 519 bp, Homo sapiens
  misc_feature: HEFZJCU01CDY9L.4.28.C06.1.454.heavy.3.raw
  modified_base (464)..(464): a, c, t, g, unknown or other
agcactgtagcacgaccggtgctcgatttagagctcacgtattgggtttgggggccccagccctgggattcccagctgtttctgcttgctgatcaggactgcacacagagaactcaccatggaatttgggctgagctgggttttccttgttgctattttaaaaggtgtccagtgtgaggtgctcctggtggagtccgggggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgaggggccgattcaccatcttcagagacaacgccaaggacacgctgtatctggaaatgagcagtctgagagccgaggacacggctgtgtattactgtncaaggagataacggacttggtactccctttgactacgtgggggccccgggacctc

SEQ ID NO: 464118 - DNA, 313 bp, Homo sapiens; identical to SEQ ID NO: 444518
  misc_feature: HEFZJCU01AUBL0.7.10.A10.1.454.heavy.3.raw

SEQ ID NO: 464119 - DNA, 510 bp, Homo sapiens; identical to SEQ ID NO: 457102
  misc_feature: HEFZJCU01BD3GD.18.39.D06.1.454.heavy.3.raw

SEQ ID NO: 464120 - DNA, 511 bp, Homo sapiens
  misc_feature: HEFZJCU01EDZ62.14.61.F06.1.454.heavy.3.raw
cgtctagtaccacgaccggtgctcgatttagctacgctctaagggaaaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagatgcctggggcctcagttgaggtctcctgcaggacttctggttacacctttaccaactatggtatcacctgggtgcggcaggtcccaggacaagggcttgagtggctgggatggatcagcggtttcgatgagaaaaccagttctgcacaaaagttccagggcagactcaccctgactacagacgcatcaacgggctcagccttcatgaccctgaggaacctgagacctgacgacgcggccatctattactgtgcgagagatgggtggcagctcggtctcaggaattgacttctggggcccgggaacctgatc

SEQ ID NO: 464121 - DNA, 517 bp, Homo sapiens; identical to SEQ ID NO: 459337
  misc_feature: HEFZJCU01BERP9.14.14.B03.1.454.heavy.3.raw

SEQ ID NO: 464122 - DNA, 497 bp, Homo sapiens; identical to SEQ ID NO: 445400
  misc_feature: HEFZJCU01BF20V.40.37.D04.1.454.heavy.3.raw

SEQ ID NO: 464123 - DNA, 497 bp, Homo sapiens
  misc_feature: HEFZJCU01AVC1J.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctggggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactggtgggagagagtgggaggtcgatattgta

SEQ ID NO: 464124 - DNA, 429 bp, Homo sapiens; identical to SEQ ID NO: 447944
  misc_feature: HEFZJCU01EEKP5.4.37.D04.1.454.heavy.3.raw

SEQ ID NO: 464125 - DNA, 379 bp, Homo sapiens; identical to SEQ ID NO: 444450
  misc_feature: HEFZJCU01DJFKP.47.77.G11.1.454.heavy.3.raw

SEQ ID NO: 464126 - DNA, 496 bp, Homo sapiens; identical to SEQ ID NO: 444697
  misc_feature: HEFZJCU01DQJM8.16.37.D04.1.454.heavy.3.raw

SEQ ID NO: 464127 - DNA, 512 bp, Homo sapiens; identical to SEQ ID NO: 450914
  misc_feature: HEFZJCU01D4S2U.15.67.G01.1.454.heavy.3.raw

SEQ ID NO: 464128 - DNA, 534 bp, Homo sapiens
  misc_feature: HEFZJCU01CWNIJ.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctgggagtgggtctcagcaatcagtggttctagtggaagtacattcgacgccgtctccgtgaagggccggttctccatctccagagacaattccaagaacactctatttcttcaaatggacagccctgaaagacgaagacacgggcgtgtatttttgtgtgaaagatacgaagtctatgatacccaatttgggaggggcctttcatgtctgggcaagggacgctggtcaccgtctcttcagcctccaccaagggcccatcggtcttcccctggcaccctcctccaacgagcacctctgggggcac

SEQ ID NO: 464129 - DNA, 518 bp, Homo sapiens; identical to SEQ ID NO: 448653
  misc_feature: HEFZJCU01CKULT.13.76.G10.1.454.heavy.3.raw

SEQ ID NO: 464130 - DNA, 501 bp, Homo sapiens
  misc_feature: HEFZJCU01AT765.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttcccctggcgccctgctccaggagcacctcccgagagcacagcggccctgggctgcctggtcaaggactacttccga

SEQ ID NO: 464131 - DNA, 485 bp, Homo sapiens
  misc_feature: HEFZJCU01CQGTH.12.40.D07.1.454.heavy.3.raw
atacgacgtacacgaccggtgctcgatttagtgatagagcgtaacaacagaggactcaccatggagtttgggctgagctgggtttcctcgttgctcttttaagaggtgtccagtgtcaggggcacctggtggagtctggggctctgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggagccaggggaccctggtcatcgtcctccccagcctccaccaagggcccatcggtcttcccctggcgccctgctccaggagcacctccgagagcacagcggccctgggctgcctggtcaaggactacttcctacgtcgtat

SEQ ID NO: 464132 - DNA, 513 bp, Homo sapiens
  misc_feature: HEFZJCU01EIS0P.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttccgtgttaggttatttagaaggtgtccagtgtgaggtgcacttggtggagtctgggggaggcttggtccagccgggggggtccctgagactctcctgtgcagtctctggattcacccttagaagttattggatgacctgggtccgccaggctccagggaaggggctggagtgggtggccaacataaacaaagacggaagtcagaaaaactatgtggactctgtgaacggccgattcaccatctccagagacaacgccaagaattcactgtatttgcaaatgaacagcctgagaggcgaggacacgggccgtgtattattgtgcgcgagatgatagtagactctacagtagcaggtggta

SEQ ID NO: 464133 - DNA, 535 bp, Homo sapiens
  misc_feature: HEFZJCU01CXQUK.12.12.B01.1.454.heavy.3.raw
atacgacgtacacgaccggtgctcgatttagtagtgtagattccgcgggggctttctgagagtcatggacctcctgtgcaggaacatgaagcacctgtggtttttcctcctgctggtggcagctcccagatggggcctgtcccaggtgcagctgcaggagtcgggcccaggactggtgaagccttcggagaccctgtccctcacctggcgctgtgtccggtttctccatcagtagtgggcattattggggctggatccgggcagcccccagggaaggggctggagtggattgggagtatctattttagcgggagcacctaccagaacgcgtcctcaagagtcgaatcaccatgtcggtggacacatcgaagaaccagatctcccttaagttgaggtctgtgaccgccgctgacacggccgtctattactgtgcgagagtccgtgctggaagaactactttttttgactattggggccagggaatcctggtcaccgtcgcctcagcctccaccaacgggccatcggtcttcccccg

SEQ ID NO: 464134 - DNA, 520 bp, Homo sapiens
  misc_feature: HEFZJCU01EF81R.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaaggaggcatatgggaagtacgattttcgatccctccgcagtcgacactttgattactggggccggggaaccctggtcgccgtctcctcagcctccaccaagggcccatcggtcttcccctggcaccctcctccaagagcacctcgtgggggcacagcggccctgggctgcctggtcaaggactacttccagacgtatca

SEQ ID NO: 464135 - DNA, 491 bp, Homo sapiens
  misc_feature: HEFZJCU01D5PZ0.40.83.H06.1.454.heavy.3.raw
tctagcgactcacgaccggtgctcgatttagatcacgtgcgtcgcggggtctgggagaggagcccagcactcgaagtcggcggtgttgccattcggtgatcagcactgaacacagaggactcaccatggagtttgggctgagctgggttttcctcgttgctcttttaagaggtgtccagtgtcaggtgcagttggtggagtctgggggaggcgtggtccagcctgggaggtcactgagactctcctgtgcatcgtccggattcaccttccataaatataacatgcactgggtccgccaggctccaggcaagggactgcagtggctggccactgtctggtcggatgaaagttatgcatactatgcagactctctggaggggccgattcatcatctctagagacaattcgaagaacacggcttatctgacaaatgaacagcctgactagtcggaaggacacggctagtatatttctgtgcgaatgagggtaac

SEQ ID NO: 464136 - DNA, 493 bp, Homo sapiens
  misc_feature: HEFZJCU01DH8KX.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaagggctggaatgggtctcatctattagtgctactactggtggcacatacttcgcagactccgtgaagggccggttctccatctccagagacaattccaagaacacgctgtatctgcaattgaacagcctgagagccgaggacacggccgtatattactgtgcgaaagatttgggggaatgaccacgtc

SEQ ID NO: 464137 - DNA, 500 bp, Homo sapiens
  misc_feature: HEFZJCU01D25JI.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaattgataggctctatggactggacttcgt

SEQ ID NO: 464138 - DNA, 525 bp, Homo sapiens
  misc_feature: HEFZJCU01BQ8QI.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcgaccctggttctacttcgatctctggggccgt

SEQ ID NO: 464139 - DNA, 498 bp, Homo sapiens
  misc_feature: HEFZJCU01CJ9EP.12.14.B03.1.454.heavy.3.raw
atacgacgtacacgaccggtgctcgatttagtgtgagtagttccgcgggggggggaggcttggttcggcctggcgggtccctgagactctcctgcgcagcctctggattcctttttgaggattttgccatgcactgggtccggcaagctccggggaggggcctggagtgggtctcaacaattacttggaatagtgctaccatagcctacacagactccgtgaagggccgattcatcacttctagagacaacgccgagaactccctgtatctgcagatgaacagtctgagacctgaggacacggccctgtatttctgttcaaaaggggctctggttcagggatggggctttgactcctgggcccagggaaccctggtcgcggtctcctcagcctccaccaagggcccatcggtcttccccctggcaccctcctccaagagcacctctgggggcacagcggccctgggctgcctggtcaggactacttcctacgtcgtat

SEQ ID NO: 464140 - DNA, 316 bp, Homo sapiens; identical to SEQ ID NO: 444479
  misc_feature: HEFZJCU01CJK5V.47.84.H07.1.454.heavy.3.raw

SEQ ID NO: 464141 - DNA, 511 bp, Homo sapiens
  misc_feature: HEFZJCU01AP62N.10.53.E09.1.454.heavy.3.raw
catagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcgtcgggggaataccttc

SEQ ID NO: 464142 - DNA, 530 bp, Homo sapiens
  misc_feature: HEFZJCU01D3H8P.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccgaggggaccctggtcatcgtctcccacgcctccaccaacgggcccatcggtccttcccctcggcgcctcg

SEQ ID NO: 464143 - DNA, 464 bp, Homo sapiens
  misc_feature: HEFZJCU01DA1WK.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacggggggaaaattggggccagggaaccctggtctccgtctcgtcagcctccaccaagggccatcggtcttccccctggccgccctgctccaggagcacctccgagagcacagcggccctgggctgcctggtcaaggactacttcccagagagta

SEQ ID NO: 464144 - DNA, 527 bp, Homo sapiens; identical to SEQ ID NO: 462900
  misc_feature: HEFZJCU01B3JPL.17.34.D01.1.454.heavy.3.raw

SEQ ID NO: 464145 - DNA, 510 bp, Homo sapiens
  misc_feature: HEFZJCU01AIWDW.9.78.H01.1.454.heavy.3.raw
tgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcaccctccgagagcacagccggccctgggctgcctggtcaaggactacttccagacgtatca

SEQ ID NO: 464146 - DNA, 525 bp, Homo sapiens
  misc_feature: HEFZJCU01D7XMI.22.85.H08.1.454.heavy.3.raw
acatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggcccgattcaccatctcagaagacaattccaggaacacattgtatcttcaaatgaataacctgagagccgaggacacggccatgtattactgtgtggggcatttacttgaccctggggccggggaaccctggtcaccgtctccccaccctccaccg

SEQ ID NO: 464147 - DNA, 520 bp, Homo sapiens; identical to SEQ ID NO: 449050
  misc_feature: HEFZJCU01AYJAC.12.40.D07.1.454.heavy.3.raw

SEQ ID NO: 464148 - DNA, 491 bp, Homo sapiens; identical to SEQ ID NO: 446104
  misc_feature: HEFZJCU01BLF6Y.3.34.D01.1.454.heavy.3.raw

SEQ ID NO: 464149 - DNA, 516 bp, Homo sapiens; identical to SEQ ID NO: 451776
  misc_feature: HEFZJCU01C389X.48.34.D01.1.454.heavy.3.raw

SEQ ID NO: 464150 - DNA, 486 bp, Homo sapiens
  misc_feature: HEFZJCU01CWA9N.47.55.E11.1.454.heavy.3.raw
agctcacgtacacgaccggtgctcgatttagcactcgcacgttgggtttgggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccagggaaccctggtcagcgtctcctcagcctccaccaagggcccatcggtcttcccctggcgcctgctccaggagcacctccgagacgcacagcggccctgggctgcctggtcaaggactacttcctacgtgagct

SEQ ID NO: 464151 - DNA, 482 bp, Homo sapiens; identical to SEQ ID NO: 444503
  misc_feature: HEFZJCU01ALEBA.7.10.A10.1.454.heavy.3.raw

SEQ ID NO: 464152 - DNA, 488 bp, Homo sapiens
  misc_feature: HEFZJCU01CK1YG.22.86.H09.1.454.heavy.3.raw
acatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgtacg

SEQ ID NO: 464153 - DNA, 497 bp, Homo sapiens; identical to SEQ ID NO: 446851
  misc_feature: HEFZJCU01D387M.3.26.C04.1.454.heavy.3.raw

SEQ ID NO: 464154 - DNA, 503 bp, Homo sapiens
  misc_feature: HEFZJCU01CT2GE.17.10.A10.1.454.heavy.3.raw
cgtagactagcacgaccggtgctcgatttagcgtcgatctcaggggacccaaaaaccacacccctccttgggagaactcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaatttgataggctctatggactggacttcgtc

SEQ ID NO: 464155 - DNA, 423 bp, Homo sapiens; identical to SEQ ID NO: 444772
  misc_feature: HEFZJCU01CPBG5.16.78.H01.1.454.heavy.3.raw

SEQ ID NO: 464156 - DNA, 521 bp, Homo sapiens
  misc_feature: HEFZJCU01BEPJZ.19.26.C04.1.454.heavy.3.raw
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctggggccaagggaccacggtcatcgtctccccagcctccaccaagggcccatcggtcttccccctcggccgccctcgcctccacggacgcaccc

SEQ ID NO: 464157 - DNA, 498 bp, Homo sapiens
  misc_feature: HEFZJCU01B80SG.52.19.B08.1.454.heavy.3.raw
cgcagtacgacacgaccggtgctcgatttagtgagtcagtaagggtgcaactggtggagtctgggggaggcgtggtccagcctgggaggtccctgagactctcttgtgctgcctctggattcaccttcagggtctatgacatgcactgggtccgccaggctccaggcaaggggctggagtgggtggcatttatatcatatgatggaagcaagatatactatgtagactccgtgaagggccgattcatcatctccagagacaactccgagaacacgctgtatctgcaaatgatcaggctgagagctgaagacacggctttatattactgtgcgaacttaatcacggaggacaacggtgacccccgtccgctcggtgcggaggtctggggccaagggaccacggtcatcgtctcctcagcctccaccaagggcccatcggtcttcccctggcaccctcctccaagagcacctctgggggcacagcggccctgggctgcct

SEQ ID NO: 464158 - DNA, 532 bp, Homo sapiens
  misc_feature: HEFZJCU01DSV5E.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaacccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagg

SEQ ID NO: 464159 - DNA, 505 bp, Homo sapiens; identical to SEQ ID NO: 445664
  misc_feature: HEFZJCU01CB94X.12.33.C11.1.454.heavy.3.raw

SEQ ID NO: 464160 - DNA, 513 bp, Homo sapiens
  misc_feature: HEFZJCU01AZX3B.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggccaccctcctccaagagcacctctgggggcacagcggccctgggctgcctggtcaaggactacttccgagtgcgtct

SEQ ID NO: 464161 - DNA, 520 bp, Homo sapiens; identical to SEQ ID NO: 449050
  misc_feature: HEFZJCU01ED2N4.12.40.D07.1.454.heavy.3.raw

SEQ ID NO: 464162 - DNA, 537 bp, Homo sapiens
  misc_feature: HEFZJCU01C914T.18.59.F04.1.454.heavy.3.raw
tacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccatgaaaggcagattcaccatctcaagagatgattcaaaagcacgctgtatctgcaaatgaacagcctgagaaccgaggacacagccgtgtattactgtaccacactcccctgaaagcgtacaactactactactacggtatggacctcgtgggccaac

SEQ ID NO: 464163 - DNA, 490 bp, Homo sapiens
  misc_feature: HEFZJCU01DO7TC.2.33.C11.1.454.heavy.3.raw
acgctcgacacacgaccggtgctcgatttagagtgagctcgttgggtttgggaggcttggtgcagccgggtgggtccctgcgactctcctgtgcaatttctgaagccccttccaatacagtgtggatgaattgggtccgccaggctccagggaaggggctggagtgggttggccatataaaagtaagactgctggtgagacaacagactacgctgctgccttcagaggcagattcaccatcttcagagatgaatcacagagcactctgtttctgcaaatgaacagcctggaagacgcggacacagccatgtattattgtacattaggacactatagtccctggggccagggaaccctcgtcaccgtctcctcagcctccaccaagggcccatcggtccttccccctgggccgccctgctccaggacgcacctccgagagcacacgcggccctgggctgccctggtcaaggactacttcctgttcgagcgt

SEQ ID NO: 464164 - DNA, 378 bp, Homo sapiens; identical to SEQ ID NO: 447263
  misc_feature: HEFZJCU01C4O7M.47.77.G11.1.454.heavy.3.raw

SEQ ID NO: 464165 - DNA, 490 bp, Homo sapiens
  misc_feature: HEFZJCU01B5QNT.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcaccctccgagagcacagcggccctgggctgcctggtcaaggactacttcctacgtgagct

SEQ ID NO: 464166 - DNA, 479 bp, Homo sapiens; identical to SEQ ID NO: 450171
  misc_feature: HEFZJCU01CMU75.14.70.G04.1.454.heavy.3.raw

SEQ ID NO: 464167 - DNA, 505 bp, Homo sapiens; identical to SEQ ID NO: 452814
  misc_feature: HEFZJCU01CN3RE.16.34.D01.1.454.heavy.3.raw

SEQ ID NO: 464168 - DNA, 500 bp, Homo sapiens
  misc_feature: HEFZJCU01BKBKH.3.20.B09.1.454.heavy.3.raw
  modified_base (449)..(449): a, c, t, g, unknown or other
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgnaacagactacggtggcaactcctatgcttttgatatctggggccaagggac

SEQ ID NO: 464169 - DNA, 511 bp, Homo sapiens
  misc_feature: HEFZJCU01A26OP.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaagggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcaacccatacctactttgactactggggccg

SEQ ID NO: 464170 - DNA, 519 bp, Homo sapiens
  misc_feature: HEFZJCU01C653T.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatacgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactgggggccgggaaccctggtcgccgtctcctcagcctccaccaagggcccatcggtcttccccctggcaccctcctccaagagcacctctgggggcacagcgcccgtgggctgcctggtcaaggactacttccgacgtatca

SEQ ID NO: 464171 - DNA, 374 bp, Homo sapiens; identical to SEQ ID NO: 444502
  misc_feature: HEFZJCU01CKNY2.9.14.B03.1.454.heavy.3.raw

SEQ ID NO: 464172 - DNA, 396 bp, Homo sapiens
  misc_feature: HEFZJCU01B6058.47.46.E02.1.454.heavy.3.raw
agctcacgtacacgaccggtgctcgatttagactcatctacaggggaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctagcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttcctacgtgacgct

SEQ ID NO: 464173 - DNA, 423 bp, Homo sapiens; identical to SEQ ID NO: 444772
  misc_feature: HEFZJCU01B095R.16.78.H01.1.454.heavy.3.raw

SEQ ID NO: 464174 - DNA, 491 bp, Homo sapiens
  misc_feature: HEFZJCU01ANZW9.40.22.B11.1.454.heavy.3.raw
tctagcgactcacgaccggtgctcgatttagacgacagctcaggggtctcagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtacagcctggggggtccctgagactctcctgtgcagcctctggattcaccttcagtagctatagcatgaactgggtccgccaggctccagggaaggggctggagtgggtttcatacattagtagtagtagtagtaccatatactacgcagactctgtgaagggccgattcaccatctccagagacaatgccaagaactcactgtatctgcaaatgaacagcctgagagacgaggacacggctgtatattactgtgcgagagagccgaggtggactact

SEQ ID NO: 464175 - DNA, 517 bp, Homo sapiens; identical to SEQ ID NO: 445616
  misc_feature: HEFZJCU01CPZCY.9.34.D01.1.454.heavy.3.raw

SEQ ID NO: 464176 - DNA, 531 bp, Homo sapiens
  misc_feature: HEFZJCU01DEY1R.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcctttttacaccttcccttgacttctgggccatggaaccccggtaccg

SEQ ID NO: 464177 - DNA, 501 bp, Homo sapiens
  misc_feature: HEFZJCU01BLYOW.3.67.G01.1.454.heavy.3.raw
agacgcactccacgaccggtgctcgatttagagtatacatattgggtttggggagctctaggagaggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgttctgcaaatgaacagcctggaagacgcggacacagccatgtattattgtacattaggacactatacg

SEQ ID NO: 464178 - DNA, 516 bp, Homo sapiens
  misc_feature: HEFZJCU01AOPR6.3.34.D01.1.454.heavy.3.raw
agacgcactccacgaccggtgctcgatttagatcgtctgtgttgggtttgggctgaactgggttttcctcgttgctcttttaagaggtatccagtgtcaggtgcacctggtggagtctgggggaggcgtggtccagcctgggacgtccctgagactctcctgtgtagcctctggattcgccttcagtcgctatgcaatgaattgggtccgccaggctccaggcaaggggctggagtgggtggcagttatatcatatgaaggaagcaataaatactacgcagactccgtgaagggccgattcaccatctccagagacaattccaagaacacgctgtttctgcaaatgaacagcctgagagatgaggacacggctgtttatcactgtgcgagggagaatcttgtagaagtaccagctcctacggacgccagcgccccgactgactacgtggggccgggggaaccctggtcaccgtctcctcagcctccaccaagggcccatcggtccttcccctggcc

SEQ ID NO: 464179 - DNA, 482 bp, Homo sapiens; identical to SEQ ID NO: 444503
  misc_feature: HEFZJCU01BIEGB.7.10.A10.1.454.heavy.3.raw

SEQ ID NO: 464180 - DNA, 528 bp, Homo sapiens
  misc_feature: HEFZJCU01EH8BN.52.9.A09.1.454.heavy.3.raw
cgcagtacgacacgaccggtgctcgatttagcgagacgcgcagggggtgctttccgagagtcatggacctcctgcacaagaacatgaaacacctgtggttcttcctcctcctggtggcagctcccagatgggtcctgtcccaggtgcacctacaacagtggggcgcaggactgttgaagccttcggagaccctgtccctcacctgcgctgtcgatggtgggtccttcagtggtcgctactggacctggatccgccagcccccagggaaggggctggagtggattggggaaatcaatcatactggaagcattaactataacccgtcccttaagagtcgagtcaccatatcagtcgacacgtccaagaaccaattctccctgaaggtgaggtctgttaccgccgcggacacggctgtctattactgtgcgaaggccctcacgatgaaactacgccctcggcgctatggacgtctggggccaagggaccacggtcaccgtctcctcagcctcaccaaggcccatcggtctt

SEQ ID NO: 464181 - DNA, 396 bp, Homo sapiens
  misc_feature: HEFZJCU01DOG35.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccgcagcctccaccaagggcccatcggtcttccccctggcgccctgctccaggagcacctccgagagcacagcggccctgggctgcctggtcaaggactacttcctacgtgagct

SEQ ID NO: 464182 - DNA, 509 bp, Homo sapiens
  misc_feature: HEFZJCU01EYD4P.47.55.E11.1.454.heavy.3.raw
agctcacgtacacgaccggtgctcgatttagcactcgcacgttgggtttgggggagccgcagccctgggattcccagctgtttctgcttgctgatcaggactgcacacagagagctcaccatggagtctgggctgagcgtggtttcgtgtaggctctttaaagtgtcagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgcctttcggtccgcgggacttctgggggccaggggaaccc

SEQ ID NO: 464183 - DNA, 336 bp, Homo sapiens; identical to SEQ ID NO: 444510
  misc_feature: HEFZJCU01A1W50.3.31.C09.1.454.heavy.3.raw

SEQ ID NO: 464184 - DNA, 512 bp, Homo sapiens; identical to SEQ ID NO: 447906
  misc_feature: HEFZJCU01CZUX4.17.33.C11.1.454.heavy.3.raw

SEQ ID NO: 464185 - DNA, 518 bp, Homo sapiens
  misc_feature: HEFZJCU01CFA2I.48.5.A05.1.454.heavy.3.raw
agtatacatacacgaccggtgctcgatttagatagatagacagggggctctgagagaggagcccagcccagggattttcaggtgttttcatttggtgatcaggactgaacagagagaactcaccatggagtttgggttgagctggctttttcttgtggctattttaaaaggtgtccagtgtgaggtgcagctgttggagtctgggggaggcttggtacagccgggggggtccctgagactctcctgtgcaacctctggattcacctttaggggctatgccatgaactgggtccgccaggttcctgggaaggggctggagtgggtctcatctattagtgagactggtgatactacagactacgcagactccgtgaggggccggttcaccgtctccagagacaattccaagaacacgctatttctgcaaatgaacagcctgagagtcgacgacacggccgtatactactgtgcgagacagatgctgccgcctgtccgtgggccagggaccctggcaccgt

SEQ ID NO: 464186 - DNA, 510 bp, Homo sapiens; identical to SEQ ID NO: 453817
  misc_feature: HEFZJCU01C6IB3.4.23.C01.1.454.heavy.3.raw

SEQ ID NO: 464187 - DNA, 395 bp, Homo sapiens; identical to SEQ ID NO: 453087
  misc_feature: HEFZJCU01BSX8F.47.46.E02.1.454.heavy.3.raw

SEQ ID NO: 464188 - DNA, 501 bp, Homo sapiens
  misc_feature: HEFZJCU01EG016.10.34.D01.1.454.heavy.3.raw
catagtagtgcacgaccggtgctcgatttagatcgtctgtgttgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagcctggggggtcccttagactctcctgtgcagcctctggattcactttcagtaacgcctggatgaactgggtccgccaggctccagggaagggctggagtgggttggccatattaaaatcaaagctgatggtgggacaacagagcacgctgcacccgtgaaaggcagattcagcatctcaagagatgattcaaaaagtacgctgtatctagaacatgaacagcctaggaaaacggaggacacagccgtgtattactgtgccactcaggaccgatattgt

SEQ ID NO: 464189 - DNA, 499 bp, Homo sapiens
  misc_feature: HEFZJCU01BIDAL.13.12.B01.1.454.heavy.3.raw
tcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaagggccgattcgccatctccagagacaattccaggaacacgctgtacctggagatggacggcctgagacctgacgacacggcaatttattactgtgcgagggtttatgtgttggaacgtggtacaccggaaaactggttcgacccctggggccagggaaccctggtcgtcgtctcgtctgcctccaccaagggcccatcggtcttcccctggcgccctgctccaggagcacctccgagagcacagcggccctgggctgcctggtcaggactacttccgtactagacg

SEQ ID NO: 464190 - DNA, 506 bp, Homo sapiens
  misc_feature: HEFZJCU01ELIKD.52.86.H09.1.454.heavy.3.raw
cgcagtacgacacgaccggtgctcgatttagtgctatagacttgggtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgtttactgtgcgagagggaactcgattacagcagccctcgaagaacatcatgatggctttgatatctggggccaagggacaatggtcattgtctcttcagcctccaccaagggcccatcggtccttccccg

SEQ ID NO: 464191 - DNA, 429 bp, Homo sapiens; identical to SEQ ID NO: 447944
  misc_feature: HEFZJCU01B2B02.4.37.D04.1.454.heavy.3.raw

SEQ ID NO: 464192 - DNA, 505 bp, Homo sapiens
  misc_feature: HEFZJCU01BRPIJ.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactta

SEQ ID NO: 464193 - DNA, 519 bp, Homo sapiens; identical to SEQ ID NO: 446650
  misc_feature: HEFZJCU01EQ10Z.13.76.G10.1.454.heavy.3.raw

SEQ ID NO: 464194 - DNA, 526 bp, Homo sapiens
  misc_feature: HEFZJCU01A6S05.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccatactatgggggcttgttctggggccaggggaccctggtcatcgtctccccagcctccaccaagggcccatcggtcttcccctggccgcctcg

SEQ ID NO: 464195 - DNA, 526 bp, Homo sapiens
  misc_feature: HEFZJCU01DFGHW.47.6.A06.1.454.heavy.3.raw
agctcacgtacacgaccggtgctcgatttagatctactgacagcacacaagggggggaaatactttctgagagtcctggacctcctgtgcaagaacatgaaacatctgtggttcttccttctcctggtggcagctcccacatgggtcctgtcccaggtgcagctgcaggagtcgggcccaggactggtgaagccttcggagaccctgtccctcacttgcactgtctctggtggctccatcaggagttactactggacctggcttcggcagtccccagggaagggactggagtggattgggtataattattacagtgggaccaccaactacaaccctcctcaagagtcgagtcaccatatcaatagacacgtcgaagaaccagttctccctgaagttgaactcagtgaccgctgcggacacggccgtgtattactgtgcgagccgacaccgattaccgatttttggagtggccttgataactgggggccaggggatcctggtcaccgtctcctcagcctccaccaac

SEQ ID NO: 464196 - DNA, 533 bp, Homo sapiens
  misc_feature: HEFZJCU01E0M2T.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccacttaggtttgacctacgtggggccaaggggaacgcgtttggtcaccgtctccctcacgcctccc

SEQ ID NO: 464197 - DNA, 511 bp, Homo sapiens
  misc_feature: HEFZJCU01EWEGY.52.78.H01.1.454.heavy.3.raw
cgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttcgtttgggatggttgtcgttgcacc

SEQ ID NO: 464198 - DNA, 507 bp, Homo sapiens; identical to SEQ ID NO: 458614
  misc_feature: HEFZJCU01BB8MP.49.59.F04.1.454.heavy.3.raw

SEQ ID NO: 464199 - DNA, 523 bp, Homo sapiens
  misc_feature: HEFZJCU01AVWDX.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaagggaggggggaaccgagcggggagttccgaagtactcctttgacgtctggggccgtac

SEQ ID NO: 464200 - DNA, 330 bp, Homo sapiens
  misc_feature: HEFZJCU01CK1AX.49.73.G07.1.454.heavy.3.raw
agtcgagagacacgaccggtgctcgatttagctctacgctcagggcacgaccggtgctcgatttagcgtcgatctcaggggtccgggagatcatgagggtgtccttgggttttggggggaagaggaagactgacggtccccccaggagttcaggtgctgaggaagagatggaggtggacgtgtcagcacccggccagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 464201 - DNA, 498 bp, Homo sapiens
  misc_feature: HEFZJCU01CSD1D.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagccatctctgatgaacaggctcaccatcaccaaggaccgcctccaaaaaccaggtggtccttacaatgaccaacatggaccctgtggacacagccacatattactgtgcacagagatacgggcagcacggtggtttggggctacgtggggccagggaaccctggcaccgtctcctcagcctccaaccg

SEQ ID NO: 464202 - DNA, 470 bp, Homo sapiens
  misc_feature: HEFZJCU01BE7ZW.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaag

SEQ ID NO: 464203 - DNA, 502 bp, Homo sapiens; identical to SEQ ID NO: 451675
  misc_feature: HEFZJCU01DC1KF.51.78.H01.1.454.heavy.3.raw

SEQ ID NO: 464204 - DNA, 513 bp, Homo sapiens
  misc_feature: HEFZJCU01CPERN.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaagggctggagtgggtggccagcatgaacggagatggaagtcaaaagactatgtggactctgtgaagggccgattcaccatctccagagacaacgccaagaactcactgtatctgcaaatgaacagcctaagacccgaggacacggctgtgtattactgtgcgagagaccgctacgtcggggcccgggagcccgtggtccg

SEQ ID NO: 464205 - DNA, 519 bp, Homo sapiens; identical to SEQ ID NO: 446650
  misc_feature: HEFZJCU01BAZSN.13.76.G10.1.454.heavy.3.raw

SEQ ID NO: 464206 - DNA, 394 bp, Homo sapiens; identical to SEQ ID NO: 444701
  misc_feature: HEFZJCU01CUCJ9.3.12.B01.1.454.heavy.3.raw

SEQ ID NO: 464207 - DNA, 370 bp, Homo sapiens; identical to SEQ ID NO: 446460
  misc_feature: HEFZJCU01EKU74.14.77.G11.1.454.heavy.3.raw

SEQ ID NO: 464208 - DNA, 395 bp, Homo sapiens
  misc_feature: HEFZJCU01BN8UF.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttcccctggcgccctgctccaggagcacctccgagagcacagcggccctgggctgcctggtcaaggactacttcctacgtgagct

SEQ ID NO: 464209 - DNA, 401 bp, Homo sapiens
  misc_feature: HEFZJCU01DPL2N.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctaacttggacgtctggggcaaagggaccgcggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 464210 - DNA, 519 bp, Homo sapiens
  misc_feature: HEFZJCU01CWRS6.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcgggggagtttattagtccctactttgactactggggccagggaactctggtcaccgtctccgcagcctccaccaagggcccatcc

SEQ ID NO: 464211 - DNA, 520 bp, Homo sapiens; identical to SEQ ID NO: 445471
  misc_feature: HEFZJCU01EBFQO.12.40.D07.1.454.heavy.3.raw

SEQ ID NO: 464212 - DNA, 379 bp, Homo sapiens; identical to SEQ ID NO: 444450
  misc_feature: HEFZJCU01BN7K4.47.77.G11.1.454.heavy.3.raw

SEQ ID NO: 464213 - DNA, 511 bp, Homo sapiens; identical to SEQ ID NO: 446224
  misc_feature: HEFZJCU01DF3NA.7.28.C06.1.454.heavy.3.raw

SEQ ID NO: 464214 - DNA, 478 bp, Homo sapiens
  misc_feature: HEFZJCU01COJVA.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagcacagcctacatggacctgagcggcctgacatctgacgacacggccgtatattctgtgcgaggg

SEQ ID NO: 464215 - DNA, 518 bp, Homo sapiens
  misc_feature: HEFZJCU01EYCCQ.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaatgaacagcctaagtcctgaggacacgggtgtatactactgtacgaaggaggggggaaccaggcgggagttccaagtacttccg

SEQ ID NO: 464216 - DNA, 505 bp, Homo sapiens
  misc_feature: HEFZJCU01C485P.13.37.D04.1.454.heavy.3.raw
tcacgtactacacgaccggtgctcgatttagtagcatactgttgggtttgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattgtaatgatggtagctgctactacactttttgactactggggccagggaaccctggtcaccgtctcttcagcctccaccaaggcccatcggtcttcccctggcacccctctccaagagcacctctgggggcacagcggccctgggctgcctggtcaaggactacttccgtactagacg

SEQ ID NO: 464217 - DNA, 522 bp, Homo sapiens
  misc_feature: HEFZJCU01D9U2M.49.37.D04.1.454.heavy.3.raw
agtcgagagacacgaccggtgctcgatttagtagcatactgttgggtttggggacccaacaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcaacggtcgtcatgggatttgactactggggccaggggaaccccggtcaccgtctcctctgcctcc

SEQ ID NO: 464218 - DNA, 489 bp, Homo sapiens; identical to SEQ ID NO: 456308
  misc_feature: HEFZJCU01BPT8U.19.53.E09.1.454.heavy.3.raw

SEQ ID NO: 464219 - DNA, 514 bp, Homo sapiens
  misc_feature: HEFZJCU01DYGPP.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccgggcagttagtcacccatacctacttttgactactggggcccg

SEQ ID NO: 464220 - DNA, 535 bp, Homo sapiens; identical to SEQ ID NO: 448705
  misc_feature: HEFZJCU01D0WWR.17.28.C06.1.454.heavy.3.raw

SEQ ID NO: 464221 - DNA, 520 bp, Homo sapiens; identical to SEQ ID NO: 453800
  misc_feature: HEFZJCU01B2NPO.3.82.H05.1.454.heavy.3.raw

SEQ ID NO: 464222 - DNA, 470 bp, Homo sapiens; identical to SEQ ID NO: 444866
  misc_feature: HEFZJCU01C2UP2.4.36.D03.1.454.heavy.3.raw

SEQ ID NO: 464223 - DNA, 532 bp, Homo sapiens
  misc_feature: HEFZJCU01DI37Z.13.64.F09.1.454.heavy.3.raw
tcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccattaaaaccagcagttatcactgggggtggatccggcagcccccggggaaggagctggagtggatggggaggatttattatactggcaatacttacgacaatccgtccctcaagagtcgagtcaccctgtccgtggacacgccgaataaccagttctccctgaaagtgacctctgtgaccgtcgcagacacggccatttattattgtgtgagatacgacttttggaatggctatgactcgatcgactactggggccctggaatcctggtcaccgtctcctcagcctccaccaaggcccatcggtcttcccctggcacct

SEQ ID NO: 464224 - DNA, 508 bp, Homo sapiens
  misc_feature: HEFZJCU01C37VQ.48.12.B01.1.454.heavy.3.raw
  modified_base (476)..(476): a, c, t, g, unknown or other
agtatacatacacgaccggtgctcgatttagtagtgtagatttgcggggagcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatcccttctctaatgtcacaagatacacacagagattccagggcagaatcacacttaccgcggacaaatccacgggcacagcgcagttggacctgagcggcctggagacctgaggacacgggccatttactactgtgcgcgggggaggtggacggngctcggttttcggagttatcatctactacttt

SEQ ID NO: 464225 - DNA, 510 bp, Homo sapiens
  misc_feature: HEFZJCU01CO10G.13.71.G05.1.454.heavy.3.raw
tcacgtactacacgaccggtgctcgatttagtgtcgtcgcaagagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctgggggaggcttggttcagcctggggggtccctgagactctcgtgtgcagcctctggatttagtttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattgtaatgatggtagctgctactactactttttgacttacg

SEQ ID NO: 464226 - DNA, 511 bp, Homo sapiens
  misc_feature: HEFZJCU01BAWRA.14.35.D02.1.454.heavy.3.raw
cgtctagtaccacgaccggtgctcgatttagcacacgatagttaggtttgggggcatcacataacaaccagattcctcctctaaagaagcccctgggagcacagctcatcaccatggactggacctggaggttcctctttgtggtggcagcagctacagctgtccagtcccaggtccagctggtgcagtctggggctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggccacagcctacatggagttgagcggcctgagatttgacgacacggccttctattactgtgcgagagaactcgctacgataaatatgcccttgcctcttgactactggggccg

SEQ ID NO: 464227 - DNA, 379 bp, Homo sapiens
  misc_feature: HEFZJCU01EPUHO.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacgggccgtatattattgtgttaaatgggatggtggctacgactcttggggccgggaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 464228 - DNA, 506 bp, Homo sapiens; identical to SEQ ID NO: 456511
  misc_feature: HEFZJCU01ESD44.52.53.E09.1.454.heavy.3.raw

SEQ ID NO: 464229 - DNA, 530 bp, Homo sapiens
  misc_feature: HEFZJCU01BQ816.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctgggactgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctcccttgactttctggggccatcggaaccccggtcg

SEQ ID NO: 464230 - DNA, 365 bp, Homo sapiens
  misc_feature: HEFZJCU01EGMF4.13.61.F06.1.454.heavy.3.raw
tcacgtactacacgaccggtgctcgatttagctacgctctaagggaaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctggggccaagggaccacggtcaccgtctcctcagcctccaccaagggcccatcggtcttccccctggcgccctgctccaggagcacctccgagagcacagcggccctgggctgcctggtcaaggactacttctagtacgtga

SEQ ID NO: 464231 - DNA, 530 bp, Homo sapiens
  misc_feature: HEFZJCU01B4DKY.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctggcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtgttatcctgatactgggccagggaaccctggtgaccgtctcctcagcctccaccaacgggcccactcggtccttcccctggccgccctcgctccaggagcaccgtccgagacgcacacgcggccctggg

SEQ ID NO: 464232 - DNA, 509 bp, Homo sapiens; identical to SEQ ID NO: 448615
  misc_feature: HEFZJCU01EH9TQ.7.28.C06.1.454.heavy.3.raw

SEQ ID NO: 464233 - DNA, 494 bp, Homo sapiens
  misc_feature: HEFZJCU01CFS4I.52.15.B04.1.454.heavy.3.raw
cgcagtacgacacgaccggtgctcgatttagacagtatatatccgcggggtccagtgtcaggtgcagctggtggagtctgggggaggcgtggtccagcctgggaggtccctgagactctcctgtgcaggctctgcatttcccttcaataactatgctatcgattgggtccgccaggctccaggcaagggactggagtgggtggcagtaatatcagctgatggaggcactaaatattacgctgattctgcgaggggccgattcaccatatccagagacaactcccaagatgtgatatatctacaaatgaacagcctgagacctgaggacacggctgtatattattgtgcgtcagggggcagtgctggccacgtgatgcttttgatttctggggccaagggacattcgtcaccgtctcctcagcctccaccaagggcccatcggtcttccccctggcaccctcctccaagagcacctctgggggcacagcggcctc

SEQ ID NO: 464234 - DNA, 522 bp, Homo sapiens
  misc_feature: HEFZJCU01D59AB.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctgggccggggaaccctggtcaccgtctcccacctccaccaagggcccatcggtcttcccctggcaccctcctccaagagcacctctgggggcacagcggccctgggctgcctggtcaaggactacttcccatactcgta

SEQ ID NO: 464235 - DNA, 516 bp, Homo sapiens
  misc_feature: HEFZJCU01AODY5.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgaccctgggccagggaacctggtcaccgtctcctcagcctccaccaagggcccatcggtcttcccctggcaccctcctccaagagcacctctgggggcacagcggccctgggctgcctggtcaaggactactccgagtagtacacg

SEQ ID NO: 464236 - DNA, 390 bp, Homo sapiens; identical to SEQ ID NO: 444541
  misc_feature: HEFZJCU01EJ0YR.16.24.C02.1.454.heavy.3.raw

SEQ ID NO: 464237 - DNA, 533 bp, Homo sapiens
  misc_feature: HEFZJCU01EJ2T1.48.34.D01.1.454.heavy.3.raw
agtatacatacacgaccggtgctcgatttagatcgtctgtgttgggtttgggcatactgttgggtttgggaagaggaagactgacggtccccccaggagttcaggtgccttggtgccgccgggggggtccctgagactctcctgtgtagcctccggattcacatttagttcccatagtatggtctgggtccgccaggctccagggaagggtctagagtggatttcatacattaggagtggcagtagtcccatatactacgcagactctgtgaagggccgattcatcatctccagagacaatgccgagaactcactgtttctgcaaatgaacagcctgagagacgaggacacggctgtttattactgtgcgagagtgcggatttcacctacacagggctggttcgacccctggggccagggaaccctagtcaccgtctcctcagcctccaccaagggcccatcggtcttcccctggccaccctcctccaagagcacctctggggcacagcggccctgggctgcctggtcaggta

SEQ ID NO: 464238 - DNA, 528 bp, Homo sapiens
  misc_feature: HEFZJCU01EHEEI.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactacgtgggggttcgacccctggggccagggaaccctggtcaccgtctcctcagcctccaaccg

SEQ ID NO: 464239 - DNA, 529 bp, Homo sapiens; identical to SEQ ID NO: 455700
  misc_feature: HEFZJCU01AXQDE.14.35.D02.1.454.heavy.3.raw

SEQ ID NO: 464240 - DNA, 483 bp, Homo sapiens
  misc_feature: HEFZJCU01CI9EM.11.23.C01.1.454.heavy.3.raw
cgagagataccacgaccggtgctcgatttagtacacgtgattagggattgggggcagggtgtacacctgtggttctcggggctgccctttggctttggagatggttttctcgatggggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctgggaccaagggaccacggtcatcgtctcctcagcctccaccaagggcccatcggtcttcccctggcaccctcctccaagagcacctctgggggcacagcggccctgggctgcctggtcaggactacttccgtatctctcg

SEQ ID NO: 464241 - DNA, 493 bp, Homo sapiens
  misc_feature: HEFZJCU01BINRO.10.29.C07.1.454.heavy.3.raw
catagtagtgcacgaccggtgctcgatttagagtgctacgaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggaatccccttcagtacctatggcatgcactgggtccgccaggctccaggcaaggggctggagtgggtggcagccatatcgtatgatgtaactaataaatactatgcagactccgtgaagggccgattcaccatctccagagacaatttcaagaacacgctgtttctgcaaatgaacagcctgagagctgaggacacggctgtgtattactgtgcgaaagatatcgcggtgtaa

SEQ ID NO: 464242 - DNA, 396 bp, Homo sapiens; identical to SEQ ID NO: 444469
  misc_feature: HEFZJCU01C0LOY.47.46.E02.1.454.heavy.3.raw

SEQ ID NO: 464243 - DNA, 504 bp, Homo sapiens; identical to SEQ ID NO: 459742
  misc_feature: HEFZJCU01CFUGS.53.54.E10.1.454.heavy.3.raw

SEQ ID NO: 464244 - DNA, 494 bp, Homo sapiens
  misc_feature: HEFZJCU01EUN2N.53.26.C04.1.454.heavy.3.raw
cgcgtatacacacgaccggtgctcgatttagtctagcgactttgggtttgggggagcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcgacagaatatgcacagaagtttcagggcagggtctccatgaccagggacagggccatcagaacagcctacatggagctgaacagactgacatctgacgacacggccgtttattattgtgtgagtagaggacccgatgacctc

SEQ ID NO: 464245 - DNA, 485 bp, Homo sapiens
  misc_feature: HEFZJCU01E0VXH.49.8.A08.1.454.heavy.3.raw
agtcgagagacacgaccggtgctcgatttagcatactctacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcatatgatggaagcaatatatactatgtagactccgtgaagggccgattcatcatctccagagacaattccgagaacacgctgtatctgcaaatgaacagctgagagctgagacacggctgtgtattactgtgcgaacttaatcacggagaaccg

SEQ ID NO: 464246 - DNA, 479 bp, Homo sapiens
  misc_feature: HEFZJCU01C9OBJ.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttcccctggcgccctgctccaggagcacctccgagagcacagcggccctgggctgcctggtcaggactacttccacgcgtatgt

SEQ ID NO: 464247 - DNA, 492 bp, Homo sapiens
  misc_feature: HEFZJCU01C3V1V.19.1.A01.1.454.heavy.3.raw
tactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactgggtgcgacaagcccctggacaagggcttgagtggatgggaggaagcatccctttctttgatactccagactacgcacagaagttccaggggcagagtcacgattaccgcggacgaatccacgagcacagtctatatggaattgaccagcctgacatcagaggacacggccgtctatttttgtgcgacagaaagagattccatactcaggcggggcactatggcagcagctg

SEQ ID NO: 464248 - DNA, 519 bp, Homo sapiens
  misc_feature: HEFZJCU01BW7Z5.8.34.D01.1.454.heavy.3.raw
ctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacgacgggcgtatactactgtacgaagggagggggaaccgagcgggagtccaagtactcttt

SEQ ID NO: 464249 - DNA, 517 bp, Homo sapiens
  misc_feature: HEFZJCU01ECW5F.13.76.G10.1.454.heavy.3.raw
tcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttattatagtagtggtagtacatactccgcagactccgtgaggggccgattcaccatctccagagacaattccaagaacacgctgttcttcaaatgaacagcctgagagccgatgacacggccgtgtattactgtgcgagagatggggcccacgaacgttactacgctatggacgtcgtggggccaagggaccg

SEQ ID NO: 464250 - DNA, 507 bp, Homo sapiens
  misc_feature: HEFZJCU01B35NT.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaacctcctccataaacacagcctacatggagttgaggagcctgacatctgacgacacggccgtctattactgtgcgagagtcccacgactccggtgagcctacggcaggcggcctttgacttcgtc

SEQ ID NO: 464251 - DNA, 521 bp, Homo sapiens
  misc_feature: HEFZJCU01BD9KX.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctggggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacgaacgttactacgctatggacgtctggggccaagggaccg

SEQ ID NO: 464252 - DNA, 532 bp, Homo sapiens
  misc_feature: HEFZJCU01BMUJQ.17.28.C06.1.454.heavy.3.raw
cgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtatggctgtgtttattggggccaggggagccctggtcaccgt

SEQ ID NO: 464253 - DNA, 379 bp, Homo sapiens; identical to SEQ ID NO: 444450
  misc_feature: HEFZJCU01BHD6P.47.77.G11.1.454.heavy.3.raw

SEQ ID NO: 464254 - DNA, 535 bp, Homo sapiens
  misc_feature: HEFZJCU01A8DWS.12.12.B01.1.454.heavy.3.raw
atacgacgtacacgaccggtgctcgatttagtagtgtagattccgcgggggctttctgagagtcatggacctcctgtgcaggaacatgaagcacctgtggtttttcctcctgctggtggcagctcccagatggggcctgtcccaggtgcagctgcaggagtcgggcccaggactggtgaagccttcggagaccctgtccctcacctgcgctgtgtccggtttctccatcagtagtgggcattattggggctggatccggcagcccccagggaaggggctggagtggattgggagtatctattttagcgggagcacctaccagaacgcgtccctcaagagtcgaatcaccatgtcggtggacacatcgaagaaccagatctcccttaagttgaggtctgtgaccgccgctgacacggccgtctattactgtgcgagagtccgtgctggaagaactactttttttgactattggggccagggaatcctggtcaccgtcgcctcagcctccaccaagggcccatcggtccttcccccg

SEQ ID NO: 464255 - DNA, 499 bp, Homo sapiens
  misc_feature: HEFZJCU01CHUN3.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagctttgatctctgggccaagggacactggtcaccgtctcttcagcctccaccaagggcccatcggtcttcccctggccgcctgctcc

SEQ ID NO: 464256 - DNA, 538 bp, Homo sapiens
  misc_feature: HEFZJCU01AE84K.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactgtcctgtgtagtctctgggttcagcgtcagtcgcgaccacatgagttggttccgccaggctccagggaaggggctggagtggctcgcacttatttacagtggtggtaccacatactacacagactccgtgaagggccgattcaccatctcagaagacaattccaggaacacattgtatcttcaaatgaataacctgagagccgaggacacggccatgtattactgtgtggggcatttacttgtacccctcggggccggggaacccgtggtcaccgtctccccacccctccaacccg

SEQ ID NO: 464257 - DNA, 514 bp, Homo sapiens; identical to SEQ ID NO: 450253
  misc_feature: HEFZJCU01EKW1A.12.33.C11.1.454.heavy.3.raw

SEQ ID NO: 464258 - DNA, 510 bp, Homo sapiens; identical to SEQ ID NO: 448108
  misc_feature: HEFZJCU01BZ956.11.13.B02.1.454.heavy.3.raw

SEQ ID NO: 464259 - DNA, 536 bp, Homo sapiens
  misc_feature: HEFZJCU01CLU5F.17.28.C06.1.454.heavy.3.raw
  modified_base (523)..(523): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaatggctgtgtttattggggccagggancccgtggtcaccg

SEQ ID NO: 464260 - DNA, 494 bp, Homo sapiens
  misc_feature: HEFZJCU01EK3SS.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggcgcctgctcaggagcacctc

SEQ ID NO: 464261 - DNA, 517 bp, Homo sapiens
  misc_feature: HEFZJCU01B0QD0.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacttcctatagtatcaactgggtgcgccaggccgctggacaacgacctgagtggatgggatgggcgaaccctaacactggtgtcacagtgtcttcacccatcctccgggacagacttaccatgaccagaactcctccataaacacagcctacatggagttgaggagcctgacatctgacgacacggccgtctattactgtgcgaggagtcccacgactccggtgagcctacgggcaggccggccttttggactttcgtgggggcccagggac

SEQ ID NO: 464262 - DNA, 506 bp, Homo sapiens; identical to SEQ ID NO: 453061
  misc_feature: HEFZJCU01AKLJ2.3.85.H08.1.454.heavy.3.raw

SEQ ID NO: 464263 - DNA, 523 bp, Homo sapiens
  misc_feature: HEFZJCU01AV8SL.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacgaacgttacctacgctagtggacgtcgtcggggccaagggaccg

SEQ ID NO: 464264 - DNA, 489 bp, Homo sapiens
  misc_feature: HEFZJCU01C9KXV.10.85.H08.1.454.heavy.3.raw
catagtagtgcacgaccggtgctcgatttagtatcactcagtcgggggctgggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctatggttcggacctctggggccagggaaccctggtcaccgtctcatcagcctccaccaagggcccatcggtcttcccctggcgccctgctccaggagcacctccgagagcacagccggcccgtgggctgcctggtcaaggactacttcccactactatg

SEQ ID NO: 464265 - DNA, 514 bp, Homo sapiens
  misc_feature: HEFZJCU01A43SU.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatggggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcaacccatactactttgactactgggggcccg

SEQ ID NO: 464266 - DNA, 521 bp, Homo sapiens; identical to SEQ ID NO: 445317
  misc_feature: HEFZJCU01C53NC.12.40.D07.1.454.heavy.3.raw

SEQ ID NO: 464267 - DNA, 470 bp, Homo sapiens; identical to SEQ ID NO: 445307
  misc_feature: HEFZJCU01B5TRJ.12.78.H01.1.454.heavy.3.raw

SEQ ID NO: 464268 - DNA, 519 bp, Homo sapiens
  misc_feature: HEFZJCU01A6CXZ.22.41.D08.1.454.heavy.3.raw
acatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttacacgtttaggagctatggtatcgtttgggtgcgacaggcccctggacaacggcctgagtggatgggatggatgaacccttctaagggaaacacaaactatgcagagaggctccagggcagagtcaccatgaccgcagacacaccaacgaccacagcctacatggagttgaggagtctgagacctgacgacacggccgtatattactgccgcgagagggcgtttcacggtgactatgagtatctcaggcactggggccaggggcaccctggtctac

SEQ ID NO: 464269 - DNA, 406 bp, Homo sapiens; identical to SEQ ID NO: 445177
  misc_feature: HEFZJCU01B6PWZ.51.77.G11.1.454.heavy.3.raw

SEQ ID NO: 464270 - DNA, 519 bp, Homo sapiens
  misc_feature: HEFZJCU01AY7YM.2.81.H04.1.454.heavy.3.raw
acgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggtttacttgttggtattttagaaggtgtccagtgtgaggtgcagctggtggagtccgggggaggctgggtccagcctggggggtccctgagactctcctgttcagcctctggattcacctttagtaggttttggatgagttgggtccgccaggctccagggaaggggctggagtgggtggccaacatagagtacgatggaagtgagaaaactatgtggactccgtgaagggccgattcaccatctccagagacaacgacaagaatttagtgtatctgcaaatgagcagcctgagagcgaggacacggctggtgtattattgtgcgag

SEQ ID NO: 464271 - DNA, 482 bp, Homo sapiens
  misc_feature: HEFZJCU01EQUFL.19.67.G01.1.454.heavy.3.raw
tactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagactttttctcagaacacactgtctcttcaaatgaacagcctgagggccgaggacacggccgtctattattgtgtgagagtttatggcgatggctggtggacagatcactggggccaggggaaccctggtcaccgtctcctcagcctccaccaagggcccatcggtcttcccctggcgccctgctccaggagtacctccgagagcacagcggccctgggctgcctggtcaaggactacttcccacgagagta

SEQ ID NO: 464272 - DNA, 497 bp, Homo sapiens; identical to SEQ ID NO: 452527
  misc_feature: HEFZJCU01DZR3Q.11.71.G05.1.454.heavy.3.raw

SEQ ID NO: 464273 - DNA, 505 bp, Homo sapiens; identical to SEQ ID NO: 447076
  misc_feature: HEFZJCU01B1GJO.10.38.D05.1.454.heavy.3.raw

SEQ ID NO: 464274 - DNA, 500 bp, Homo sapiens
  misc_feature: HEFZJCU01CNJ4X.48.73.G07.1.454.heavy.3.raw
agtatacatacacgaccggtgctcgatttagctctacgctcagggggctttctgagagtcatggatcacatgtgcaagaaaatgaagcacctgtggttcttcctcctgctggtggcggctcccagatgggtcctgtcccaggtgcagctgcaggagtcgggcccaggactggtgaagccttcggagaccctgtccctcacgtgcactgtctctggtgactccatcaacaatagtcattactactggggctggatccgccagtccccagggaaggggctggagtggattggaattatctattatagcgggagcacctactataatccgtccctcaagagtcgagtcaccatatccgtagacacatccaagaaccagttctccctgaggctgagccctgtgaccgccgcagacacggctgtctattactgtgcgacccatcgatatcatgactggttgttagggcacgtctggggccaagggaccacggtcaccgtctcctc

SEQ ID NO: 464275 - DNA, 492 bp, Homo sapiens
  misc_feature: HEFZJCU01D5ZUY.13.71.G05.1.454.heavy.3.raw
tcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatctgggggaggcgtggtccagcctggggaatccctgacactgtcttgtgtagcctctggattcagcttcagaacctatggcatgcactgggtccgccaggccccaggcaaggggctggagtggctgactcttttatcatatgatggaagtcaaaaattctatgcagactccgtgaagggccgattcaccgtctccagggacaactccaagaacaccttatatctgcagatgaacagcctgagaggtgacgactcggctgtatacttctgtgcgacaacatgatgtttggagtggatgtgtta

SEQ ID NO: 464276 - DNA, 492 bp, Homo sapiens
  misc_feature: HEFZJCU01BNT6O.11.38.D05.1.454.heavy.3.raw
cgagagataccacgaccggtgctcgatttagtatctgatagttgggtttgggggaggcttggtacagcctggggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagtggtggtagctgctactggggccagggaaccctggtccaccgtctcctcagcctccaccaagggcccatcggtcttcccctggcaccctcctccaagagcacctctgggggcacagcggccctgggctgcctggtcaaggactacttccgtatctctcg

SEQ ID NO: 464277 - DNA, 537 bp, Homo sapiens
  misc_feature: HEFZJCU01AFQME.13.64.F09.1.454.heavy.3.raw
tcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccattaaaaccagcagttatcactgggggtggatccggcagcccccggggaaggagctggagtggatggggaggatttattatactggcaatacttacgacaatccgtcctcaagagtcgagtcaccctgtccgtggacacgccgaataaccagttctccctgaaagtgacctctgtgaccgtcgcagacacggccatttattattgtgtgagatacgacttttggaatggctatgactcgatcgactactggggccctggaatcctggtcaccgtctcctcagcctccaccaagggcccatccggtcttccccctcggcacccct

SEQ ID NO: 464278 - DNA, 516 bp, Homo sapiens
  misc_feature: HEFZJCU01BB2WL.52.71.G05.1.454.heavy.3.raw
  modified_base (469)..(469): a, c, t, g, unknown or other
  modified_base (494)..(494): a, c, t, g, unknown or other
cgcagtacgacacgaccggtgctcgatttagtgtcgtcgcaagagagaggggggagagaggagcccagccctgggattttcaggtgttttcatttggtgatcaggactgaacagagagaaatcaccatggagtttgggctgagctggctttttcttgtggctattttaaaaggtggccaatgtgaggtgcagctggtggagtctgggggaggcttggtacagcccggggggtccctgagactctcctgtgcagcctctggattcagttttaccagctatgccatggcctgggtccgccaggctccagggaaggggctggagtgggtctcaggtattagtggtagtgctatgaccacattctacgcagactccgtgaagggccggttcaccatttccagagacaattccaagagtaccctgtatctgcaaatgaacagcctgagagccgacgacacggccgtatattacngtgcgaagcaattactctatggacnttatgggcccattgactacgtc

SEQ ID NO: 464279 - DNA, 512 bp, Homo sapiens
  misc_feature: HEFZJCU01EDKD6.12.1.A01.1.454.heavy.3.raw
atacgacgtacacgaccggtgctcgatttagacgtctcatcagggggggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagtagtagttattactactggggctggatccgccagcccccaggggaggggctgaagtggattgggagtgtctattatagtgggatcacctactacaacccgtccctcaagagtcgagtcaccatatccgtcgacacgtccaagaaccagttctccctgaagctgagctctgtgaccgccgcagacacggctgtgtattactgtgcgagacagccaagacagattttggagtggttactgttggactactttgactactggggccaggggaacccctggt

SEQ ID NO: 464280 - DNA, 519 bp, Homo sapiens
  misc_feature: HEFZJCU01DNF3M.10.59.F04.1.454.heavy.3.raw
catagtagtgcacgaccggtgctcgatttagtacacacacttagggattgggggctttctgagagtcatggacctcctgtgcaagaacatgaatcacctgtggttcttcctcctgctggtggcggcccccagatgggtcctgtcccagctgcagctgcatgagtcgggcccaggactggtgaggccttcggataccctgtccctcagttgcgctgtctctggtggctccatcaacagtggtgacaactggtggggctgggtccgccagcccccagggatgggactggagtggattggccttacacattatagtgggactacccactacaacccgtccctcaggagtcgagtcaccatctcactagacacgtccaggaatcacctctccctgacggtgacctctgtgaccgccgcggacacggccgtgtattattgtgcgagacgaccccgctgaagtattcctcaatgtactttgaccacgtggggccagggacgcccgtggtccaccgtctcctcacg

SEQ ID NO: 464281 - DNA, 509 bp, Homo sapiens
  misc_feature: HEFZJCU01AVT09.9.78.H01.1.454.heavy.3.raw
tgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctatgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctgggctgcctggtcaaaggactacttccagacgtatca

SEQ ID NO: 464282 - DNA, 372 bp, Homo sapiens; identical to SEQ ID NO: 444727
  misc_feature: HEFZJCU01BU1ON.3.42.D09.1.454.heavy.3.raw

SEQ ID NO: 464283 - DNA, 519 bp, Homo sapiens
  misc_feature: HEFZJCU01ETVKG.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccagcgggagttccaagtactcctttgacgtctggggccgtac

SEQ ID NO: 464284 - DNA, 423 bp, Homo sapiens
  misc_feature: HEFZJCU01DFKQB.51.41.D08.1.454.heavy.3.raw
cgatcgtatacacgaccggtgctcgatttagtcacgcgagaaagggaaaggggctggagtgggtaggtttctttagaggcaaagcttatggtgggacaacagaatacgccgcgtctgtgataggccgattcaccatctcaagagatgattccaaaagcatcgcctatctgcacatgagcagcctgaaaaccgaggacacagccgtgtatttctgtactagagtcttcttatattactatgatactagtggttattcaggagtggggcacggtatggacgtctggggccaagggaccacggtcaccgtctcctcagcctccaccaagggcccatcggtcttccccctggcaccctcctccaagagcacctctgggggcacagcggccctgggctgcctggtcaggactacttcctcgtagcact

SEQ ID NO: 464285 - DNA, 490 bp, Homo sapiens
  misc_feature: HEFZJCU01A072B.19.53.E09.1.454.heavy.3.raw
tactctcgtgcacgaccggtgctcgatttagagagagtgtgttgggtttgggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggccgccctgctccaggagcacctccgagagcacagcggccctgggctgcctggtcaaggactacttcccacgagagta

SEQ ID NO: 464286 - DNA, 498 bp, Homo sapiens
  misc_feature: HEFZJCU01CDP6M.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcggaggggctgggagtggggtggcgattatatcacatgatggaactaatagacgctatgccgactccgtgaagggccgattcaccatctccagagacaattccaagaacacgcagtatctgacaatgaacagcctgagagctgaggacacggctgtgtattactggtggggagagatggaggtcgatattgta

SEQ ID NO: 464287 - DNA, 487 bp, Homo sapiens
  misc_feature: HEFZJCU01DQ1QZ.4.53.E09.1.454.heavy.3.raw
agcactgtagcacgaccggtgctcgatttagagagagtgtgttgggtttggggggtccctgagactctcctgtacagtctctgcatctaccttcacttctttttggatgacctggctccgccgggctccagggagggggctggagtgggtggccaccatcaatcaagatggaagtgagagaacctatgtggactctgtgaagggccgattcaccatctccagagacaacgccaagaattctctgtatctgcaaatgaacagcctgagagccgaggactcggctgtctattactgtgcgaggaagaagtattactatgatacaagtgacatgggctggttcgacccctggggccagggaaccctggtcaccgtctcctcagcctccaccaagggcccatcggtcttcccctggcgccctgctccaggagcacctccgagagcacagcggccctggctgcctggtcaaggctacttccctacacgtgct

SEQ ID NO: 464288 - DNA, 509 bp, Homo sapiens; identical to SEQ ID NO: 445824
  misc_feature: HEFZJCU01EIEA1.9.14.B03.1.454.heavy.3.raw

SEQ ID NO: 464289 - DNA, 527 bp, Homo sapiens
  misc_feature: HEFZJCU01ECAVO.22.85.H08.1.454.heavy.3.raw
acatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttactcgacccctggggccggggaaccctggtccaccgtctccccaccctccacccg

SEQ ID NO: 464290 - DNA, 513 bp, Homo sapiens
  misc_feature: HEFZJCU01A09JE.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtcgtggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgagggccgattcatcatctccagagacaacgccgacaactcactgtctctgctgatgagcagcctgagagccgacgacacggctatctattactgtgcgaaactctcattccgttcatctgaatacgtggggccagggaaccctggtccgtccg

SEQ ID NO: 464291 - DNA, 411 bp, Homo sapiens; identical to SEQ ID NO: 451908
  misc_feature: HEFZJCU01EIXYR.53.68.G02.1.454.heavy.3.raw

SEQ ID NO: 464292 - DNA, 518 bp, Homo sapiens; identical to SEQ ID NO: 444718
  misc_feature: HEFZJCU01A5PYT.9.34.D01.1.454.heavy.3.raw

SEQ ID NO: 464293 - DNA, 537 bp, Homo sapiens; identical to SEQ ID NO: 445697
  misc_feature: HEFZJCU01D5YP4.14.57.F02.1.454.heavy.3.raw

SEQ ID NO: 464294 - DNA, 509 bp, Homo sapiens; identical to SEQ ID NO: 444586
  misc_feature: HEFZJCU01CQT3B.12.78.H01.1.454.heavy.3.raw

SEQ ID NO: 464295 - DNA, 505 bp, Homo sapiens
  misc_feature: HEFZJCU01D0MAF.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctatattgtgcgcgacatgactacgctcaattctggggccagggacg

SEQ ID NO: 464296 - DNA, 436 bp, Homo sapiens; identical to SEQ ID NO: 454807
  misc_feature: HEFZJCU01BJ5B6.3.21.B10.1.454.heavy.3.raw

SEQ ID NO: 464297 - DNA, 510 bp, Homo sapiens
  misc_feature: HEFZJCU01D0WRM.5.20.B09.1.454.heavy.3.raw
atcagacacgcacgaccggtgctcgatttagtgtagtgtgaaggggagctctgggagacgagcccagcactggaagtcgccggtgtttccattcggtgatcatcactgaacacagaggactcaccatggagtttgggctgaactgggttttcctcgttgctcttttaagaggtgtccactgtcaggtgcaactggtggagtctgggggaggcgtggtccagcctggaacgtccctgagactctcctgtgcagcctctgggttcacctacaataaatatgctatgcactgggcccgccaggctccaggcaaggggctggagtgggtggcagttatctcagacgatgaaagtcataaatactacacagactccgtgaagggccgattcaccatctccagagacaattaccaaaaagatgttatatctgcaaatgaacagcctgagacctgaggacacggctgtatattattgtgtgacggggactcaactcgtgggggacccacgtttgacg

SEQ ID NO: 464298 - DNA, 400 bp, Homo sapiens; identical to SEQ ID NO: 444452
  misc_feature: HEFZJCU01BTW50.47.24.C02.1.454.heavy.3.raw

SEQ ID NO: 464299 - DNA, 512 bp, Homo sapiens
  misc_feature: HEFZJCU01B1EYR.11.13.B02.1.454.heavy.3.raw
  modified_base (257)..(257): a, c, t, g, unknown or other
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacngtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaaggcccatcggtcttcccctggcgccctgctccacggagcacctccgagacgcacagcggccctggg

SEQ ID NO: 464300 - DNA, 515 bp, Homo sapiens
  misc_feature: HEFZJCU01DGS35.7.71.G05.1.454.heavy.3.raw
cgtgtctctacacgaccggtgctcgatttagtgtcgtcgcaagagagaggggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaatgaacagcctaagtcctgaggacacgggtgtatactactgtacgaagggaggggggaaccgagcgggagttccaagtactcctttg

SEQ ID NO: 464301 - DNA, 536 bp, Homo sapiens
  misc_feature: HEFZJCU01BXXP6.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatacgtggggccgagggaaccctggtgaccgtctcctcagcctccaccacgggcccagtcggtccttccccgtcggccgccctgctccaggagcacctccgagagcacagccggcccgtgggtcg

SEQ ID NO: 464302 - DNA, 532 bp, Homo sapiens
  misc_feature: HEFZJCU01EDS6X.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcctttttacacctcccttgacttctggggtccatcggaaccccggtccg

SEQ ID NO: 464303 - DNA, 516 bp, Homo sapiens; identical to SEQ ID NO: 446991
  misc_feature: HEFZJCU01E078B.3.20.B09.1.454.heavy.3.raw

SEQ ID NO: 464304 - DNA, 462 bp, Homo sapiens
  misc_feature: HEFZJCU01EP3OI.4.82.H05.1.454.heavy.3.raw
agcactgtagcacgaccggtgctcgatttagtcgagctctctcgcggggagagcatcacccagcaaccacatctgtcctctagagaatcccctgagagctccgttcctcaccatggactggacctggaggatcctcttcttggtggcagcagccacaggagcccactcccaggtgcagctgatgcagtctggggctgaggtgaagaagcctggggcctcagtgatggtctcctgcaaggcttctggattcaccttcaccggctactatttgcactgggtgcgacaggcccctggacaagggcttgagtggatgggatggatcaaccctaatagtggtgccacacactatgcacagacttttctgggcagggtcaccatgaccaggggacacgtccatcagcacagcctacatggagctgagcaggctgagatctgacgacacggccgtgtattactgtgtgt

SEQ ID NO: 464305 - DNA, 505 bp, Homo sapiens
  misc_feature: HEFZJCU01EA15A.11.19.B08.1.454.heavy.3.raw
  modified_base (499)..(499): a, c, t, g, unknown or other
cgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtctgggggaagcttggtacagcctggagggtccctgagactcttctgtgcagcctctggattcgactttagtagttatgaaatgaactgggtccgccaggctccagggaaggggctggagtgggtttcatacatttctagtaattctggtaccatacactatgcagtctctgtgaagggccgattcaccatctccagagacaacgccaggaactcactttatctgcaaatgagcagcctgagagtcgaggacacgggtatttattactgtgcgagagatagtctgtctatgctttccgggganctaact

SEQ ID NO: 464306 - DNA, 547 bp, Homo sapiens
  misc_feature: HEFZJCU01ENNJR.49.83.H06.1.454.heavy.3.raw
agtcgagagacacgaccggtgctcgatttagatcacgtgcgtcgcggggtgtgcaagaacatgaagcacctgtggttcgtcctcctgctggtggcggctcccagatgggtcctgtcccagctgcaactgcaggagtcgggcccaggactggtgaagccttcggagaccctgtccctcacctgcagtgtctctggtggctccatcagcagtagtgattactactggggctggatccgccacgcccccaggggaagggactggagtggattgggagtgtcttttatactggaaacacctactacaacccgtccctcaagagtcgagtcagcatatcagtagacacgtccaagagccagttctctctgaagctgacgtctctgaacgccgcggacacggccatttattactgtgcgagtaccccggtaacctttttacgatttttggagtggttactattaccggtagtgggggtccttttgactttcgttgggggccaggggaaccctggtccaccgtctcctcagcctccaccaagggcccatcggtt

SEQ ID NO: 464307 - DNA, 449 bp, Homo sapiens
  misc_feature: HEFZJCU01COGSK.9.10.A10.1.454.heavy.3.raw
tgatacgtctcacgaccggtgctcgatttagcgtcgatctcaggggagggaattgtgagcggataacaattcccctctagaaataattttgtttaactttaagaaggagatatacatatgagtcttgacatccagtgtgagcagctgagtgatgcccggtggatggagcttctccccttgatccagcagtaccaggtggtcaggctggacgactgtggcctcactgaggtgcgatgcaaggacatcagctctgcgctccgagccaacccatccctgactgagctcagcctgcgcaccaatgagctgggggatgccggcgtgcacctggtgctccagggcctgcagagccccacctgcaagatccagaaactgagcctgcagaactgctgcctcacggaggcgggctgcggcgtcctgccctggtcaaggactacttccagacgtactca

SEQ ID NO: 464308 - DNA, 518 bp, Homo sapiens
  misc_feature: HEFZJCU01C7COA.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatcttccagagacaattccaggaacacaatgtatttggaaatgaacagcctaagtcctgaggacacgggtgtatactactgtacgaaggaggggggaaccgagcgggagttccaagtactcctttgacgtctgggctac

SEQ ID NO: 464309 - DNA, 520 bp, Homo sapiens
  misc_feature: HEFZJCU01AM5D6.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaagggctggaatgggtctcaggtattactgggtggtggttataccacatactacgcagactccgtgaagggccggttcaccatctccagagacaattccaagaacacactgtatctgcaaatgaacagcctgagagccgacgacacggccatatattacttgtgcgaaagccgaccggcaaggttagtcacccatacttactttgacctacgtggggacccg

SEQ ID NO: 464310 - DNA, 517 bp, Homo sapiens
  misc_feature: HEFZJCU01DBX89.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctgggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctctacttccgttcatctagaatacgtggggccagggaaccctggtccgtccg

SEQ ID NO: 464311 - DNA, 527 bp, Homo sapiens
  misc_feature: HEFZJCU01BBPBK.14.35.D02.1.454.heavy.3.raw
cgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggccacagcctacatggagttgagcggcctgagatttgacgacacggccttctattactgtgcgagagaactcgctacgataaatatgcccttgcctcttgactactggggccagggaaccctggtcaccgtctcctcagcctccaccaaggcccatcggtcttcccctggcaccctcctccaagagcacctctgggggcacagcggccctgggctgcctggtcaaggactacttccg

SEQ ID NO: 464312 - DNA, 523 bp, Homo sapiens; identical to SEQ ID NO: 453319
  misc_feature: HEFZJCU01C8ZY7.12.86.H09.1.454.heavy.3.raw

SEQ ID NO: 464313 - DNA, 517 bp, Homo sapiens
  misc_feature: HEFZJCU01D1BAZ.53.33.C11.1.454.heavy.3.raw
cgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgacaaatggacagcctgagagctgaagacacggctgtgtattactgtgcgagtgagatgtcttactatgatgccagtggtttggtaccgttcgacccgtggggccgagggaacccgtggtcaccgtctcctcagcttccaccaacggcccactcggtccttccccctcggccgtcccg

SEQ ID NO: 464314 - DNA, 533 bp, Homo sapiens
  misc_feature: HEFZJCU01DDMGV.16.87.H10.1.454.heavy.3.raw
tgtactactccacgaccggtgctcgatttagcagtactgcgttgggtttgggggagcccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtggaaacagttatgggttggggggagtttgggttttttttcgtacgttacgggt

SEQ ID NO: 464315 - DNA, 489 bp, Homo sapiens
  misc_feature: HEFZJCU01BMXRL.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggccacggtcaccgtctcctcggcctccaccaagggcccatcggtcttccccctggcgccctgctccaggagcacctccgagagcacagcggccctgggctgcctggtcaaggactacttcccatactcgta

SEQ ID NO: 464316 - DNA, 523 bp, Homo sapiens
  misc_feature: HEFZJCU01C7II5.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccaggtcaccgtctcctcagcctccaccaagggacccatccgtcttccccctggcgccctgctccaggagcacctccgagagcacagcggccctgggctgcctggtcaaggactacttcctacg

SEQ ID NO: 464317 - DNA, 477 bp, Homo sapiens; identical to SEQ ID NO: 444659
  misc_feature: HEFZJCU01EMOHW.16.10.A10.1.454.heavy.3.raw

SEQ ID NO: 464318 - DNA, 508 bp, Homo sapiens
  misc_feature: HEFZJCU01B28ME.48.44.D11.1.454.heavy.3.raw
agtatacatacacgaccggtgctcgatttagcgcagtacgaaggggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttatattgtacttctgaggtgacgggaaccgctggctattggggccagggaaccctggtcgccgtctcctcagcctccaccaagggcccatcggtcttcccctggccgccctgctccaggacgcacctccgagagcacagcggccctgggctgcctggtcaaggactacttcctatgtatact

SEQ ID NO: 464319 - DNA, 400 bp, Homo sapiens; identical to SEQ ID NO: 444452
  misc_feature: HEFZJCU01D3C00.47.24.C02.1.454.heavy.3.raw

SEQ ID NO: 464320 - DNA, 535 bp, Homo sapiens
  misc_feature: HEFZJCU01COFO2.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacgggctgtttattactgtacgaaagaggggggatacagtggcagctcaagtactactttgacttctggggccagggaaccctggtcaccgtctcctcagcctccaccaaggcccatcggtcttccccctggccgcctcgcctccgacggagccaccctccgacgacg

SEQ ID NO: 464321 - DNA, 513 bp, Homo sapiens
  misc_feature: HEFZJCU01DMZAP.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttgggtccagccgggggggtccctgagactctcctgtgcagtctctggattcacccttagaagttattggatgacctgggtccgccaggctccagggaaggggctggagtgggtggccaacataaacaaagacggaagtcagaaaaactatgtggactctgtgaacggccgattcaccatctccagagacaacgccaagaattcactgtatttgcaaatgaacagcctgagaggcgaggacacggccgtgtattattgtgcgcgagatgatagtagactctacagtagcaggtggta

SEQ ID NO: 464322 - DNA, 487 bp, Homo sapiens
  misc_feature: HEFZJCU01DE2FJ.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctccctcagcctccaccaagggcccatcggtcttccccctggcgccctgctccaggagcacctccgacgagccacacgcggccctgggctgcctggtcaaggactacttcccactactatg

SEQ ID NO: 464323 - DNA, 500 bp, Homo sapiens
  misc_feature: HEFZJCU01BMVGF.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctcctgaagctgagggctgtgagcgccgcagacacggccgtgtattactgtgcgagactggccgcaacagactacggtggcaactcctatgcttttgatatctggggccaaggggac

SEQ ID NO: 464324 - DNA, 519 bp, Homo sapiens
  misc_feature: HEFZJCU01EYUQ1.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgagggccgattcaccatctcagagacaattccaagaacacgctgtttcttcaaatgaacagcctgagagccgatgacacggccgtgtattactgtgcgagagagtggggcccacgaacgttactacgctatggacgtcgtggggccgaagggaccg

SEQ ID NO: 464325 - DNA, 523 bp, Homo sapiens
  misc_feature: HEFZJCU01CQVOM.47.64.F09.1.454.heavy.3.raw
agctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcaccagttttaattattggtggggctggatccgccagcccccagggaaggggctggaatggattgggagtatattttataatggggacactctttacaacccatccctcaagagtcgagtttccatatccgcagacacgtccgagaatcacttctccctgaaactgagctctgtgaccgccgcagacacggctgtttattactgttcgagacatgccgaccgagagcattatcggcagtacggttttgattatttggggccaagggacaaggggtcaccgtctccgcagcctccaaccg

SEQ ID NO: 464326 - DNA, 513 bp, Homo sapiens
  misc_feature: HEFZJCU01BCQNH.47.55.E11.1.454.heavy.3.raw
agctcacgtacacgaccggtgctcgatttagcactcgcacgttgggtttgggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccagggtaacccg

SEQ ID NO: 464327 - DNA, 511 bp, Homo sapiens
  misc_feature: HEFZJCU01BKYS9.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggactctggtcaccgtctccgcagcctccaccaaggccc

SEQ ID NO: 464328 - DNA, 537 bp, Homo sapiens
  misc_feature: HEFZJCU01EVAA8.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaaccaggtggtccttacaatgaccaccatggaccctgtggacacagccacatatttctgtgcacactctataggagcacctggtagtctgccaaactggttcgaccctggggcccgggaacccgtggtcaccgtcctcctcagcctccaccaacgggcccatcggtcttccccctc

SEQ ID NO: 464329 - DNA, 543 bp, Homo sapiens
  misc_feature: HEFZJCU01AFLMZ.52.57.F02.1.454.heavy.3.raw
cgcagtacgacacgaccggtgctcgatttagctcgatatagttgggtttgggctgagctggctctttcttgtggctattttaaaaggtgtccagtgtgacgtacagctggtggagtcggggggagccttccaacacccgggggggtccctgagactcacctgtgaagcctctggatttagatttagcagccatgccatgacctgggtccgccaggctccaggtcaggggctggagtgggtctcaggtattagcggaactagtgataccacgtactacgcggactctgtgaagggccgcttcaccatctctagggacagttccaagaacacgctgtatctgcaaatgaatagcctgagagtcgaggacacggccgtttattactgtgcgaaagatcgaggtcgcatgacagtttttggagttggccaaagacggcaggttccgctacgggttggacgtctggggccaagggaccacggtcaccgtcgcctcagcctccaccaacgggcccatcggtcttccccctggccaccctcctccaagag

SEQ ID NO: 464330 - DNA, 523 bp, Homo sapiens
  misc_feature: HEFZJCU01DFLKA.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattacgtgggggcccggggaaccctggtcgccgtctcctcagcctccaccaagggcccatcggtcttccccctggcaccctcctccaagagcacctctgggggcacagccggccctgggctgcctggtcaaggactacttccagacgtatca

SEQ ID NO: 464331 - DNA, 375 bp, Homo sapiens; identical to SEQ ID NO: 446168
  misc_feature: HEFZJCU01ELJXS.13.78.H01.1.454.heavy.3.raw

SEQ ID NO: 464332 - DNA, 498 bp, Homo sapiens
  misc_feature: HEFZJCU01A8SED.53.80.H03.1.454.heavy.3.raw
cgcgtatacacacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacacgtccatcagcactgcctacatggagctgaccaggctgaaatttgaggacacggccatttattactgtgcaaggaacagcataatgactcgtccccggactttacg

SEQ ID NO: 464333 - DNA, 519 bp, Homo sapiens
  misc_feature: HEFZJCU01CDDM8.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctggggccaaggtacagcggtcaccgtcgcctcagcctccaccaagggcccatcggtcttcccctgcaccctcctccaagagcacctctgggggcacacg

SEQ ID NO: 464334 - DNA, 528 bp, Homo sapiens
  misc_feature: HEFZJCU01ELFK7.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccagtgtgaggtgcagttggtggagactggaggaggcttgatccagcctggggggtcccttagactccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacggccgtgtattactgtactagacaggtggattacagttttggggggatttatcggacgtaaaacc

SEQ ID NO: 464335 - DNA, 499 bp, Homo sapiens
  misc_feature: HEFZJCU01AKDSS.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtcttcccctgcgccctgctccaggagcacctccgagagcacagcggccctgggctgcctggtcaaggactacttcctacgtcgtat

SEQ ID NO: 464336 - DNA, 396 bp, Homo sapiens; identical to SEQ ID NO: 444469
  misc_feature: HEFZJCU01C0T4Q.47.46.E02.1.454.heavy.3.raw

SEQ ID NO: 464337 - DNA, 491 bp, Homo sapiens; identical to SEQ ID NO: 452377
  misc_feature: HEFZJCU01B7BCQ.4.28.C06.1.454.heavy.3.raw

SEQ ID NO: 464338 - DNA, 392 bp, Homo sapiens; identical to SEQ ID NO: 444682
  misc_feature: HEFZJCU01D2KL5.16.70.G04.1.454.heavy.3.raw

SEQ ID NO: 464339 - DNA, 506 bp, Homo sapiens; identical to SEQ ID NO: 445864
  misc_feature: HEFZJCU01EZ4AK.13.37.D04.1.454.heavy.3.raw

SEQ ID NO: 464340 - DNA, 506 bp, Homo sapiens
  misc_feature: HEFZJCU01AYVUO.53.33.C11.1.454.heavy.3.raw
cgcgtatacacacgaccggtgctcgatttagagtgagctcgttgggtttgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgaccctggggccagggaaccctggtcaccgtctcctcagcttccaccaagggcccatcggtcttccccctggcgccctgctccaggagcacctctgggggcacagcggccctgggctgcctggtcaaggactacttcctcgtact

SEQ ID NO: 464341 - DNA, 519 bp, Homo sapiens
  misc_feature: HEFZJCU01CCATJ.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggtcggggacctcacctggttctacttcgatctctgggcc

SEQ ID NO: 464342 - DNA, 538 bp, Homo sapiens
  misc_feature: HEFZJCU01EFH36.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaaggcccatcggtcttcccctcggcaccctcctccaagagcacctctggggggcacagcc

SEQ ID NO: 464343 - DNA, 515 bp, Homo sapiens
  misc_feature: HEFZJCU01BSEOD.48.33.C11.1.454.heavy.3.raw
agtatacatacacgaccggtgctcgatttagagtgagctcgttgggtttgggttttccttgttgctattttagaaggtgtccagtgtgaagtgcagctggtggagtctgggggaggcttggtccagcctggggggtccctaagactctcctgtgcagcctctggattcacctttagtacctattggatgacctgggtccgccaatctccagggggggggctggagtgggtggccaatataaagggagatggaagtgtgacacactatgtggactctgtgaagggccgattcaccatctccagagacaatgccaaggagtcactgtatctgcagatgaacagcctgagagccgaggacgcggctgtgtattactgtgcgagagatgcgaatccctctgatagtaatggtcgttattatgatgcttttgatatgtggggccaagggacaacgggtcaccgtctcttcagcctccaccaagggcccatcggtcttcccctggcgcctgctccaggacg

SEQ ID NO: 464344 - DNA, 491 bp, Homo sapiens
  misc_feature: HEFZJCU01A6PBH.51.52.E08.1.454.heavy.3.raw
cgatcgtatacacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagcctggggcctcagtgaaggtctcctgcaagacttctggatacaccttcaccgactactatatgcactgggtgcgacaggcccctggacaagggcttgagtggatgggatggatcgaccctaagaatggtgccacaaactatgcacagacttttcagggctgggtcaccatgaccagcgacacatctagcaacacagtctacatggagttgaccagcctgaccgacacggccgtgtatttttgtgtgagagattttcggactaatccagagacccctgtc

SEQ ID NO: 464345 - DNA, 533 bp, Homo sapiens; identical to SEQ ID NO: 456012
  misc_feature: HEFZJCU01EXNVR.17.28.C06.1.454.heavy.3.raw

SEQ ID NO: 464346 - DNA, 517 bp, Homo sapiens
  misc_feature: HEFZJCU01BGM1Y.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagcgtggttttccgttgttaggctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacaggcccgtgtattactgtgcgagagatggggcccacgaacgttactacgctatggacgtctggggccg

SEQ ID NO: 464347 - DNA, 477 bp, Homo sapiens; identical to SEQ ID NO: 444659
  misc_feature: HEFZJCU01C9M7O.16.10.A10.1.454.heavy.3.raw

SEQ ID NO: 464348 - DNA, 396 bp, Homo sapiens; identical to SEQ ID NO: 444469
  misc_feature: HEFZJCU01AF7FR.47.46.E02.1.454.heavy.3.raw

SEQ ID NO: 464349 - DNA, 513 bp, Homo sapiens
  misc_feature: HEFZJCU01DXXH8.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcagatgaacagcctgagagccgatgacacggccgtgtattactgtgcgagagatggggcccacgaacgttactacgctatggacgtcgtgggccaac

SEQ ID NO: 464350 - DNA, 517 bp, Homo sapiens
  misc_feature: HEFZJCU01ECK92.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaatgaacaccctgcgagccgaggacacggccgtatattactgtgcgagaataaccgtcgcctggttattacc

SEQ ID NO: 464351 - DNA, 496 bp, Homo sapiens; identical to SEQ ID NO: 444697
  misc_feature: HEFZJCU01CYN1D.16.37.D04.1.454.heavy.3.raw

SEQ ID NO: 464352 - DNA, 511 bp, Homo sapiens
  misc_feature: HEFZJCU01EC53T.48.39.D06.1.454.heavy.3.raw
agtatacatacacgaccggtgctcgatttagtgacatctcgcagttctttgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtcgaccgccgcagaccgacggctgtactattactgtgcgacggcccgagcgcagtggtcgttttgatgtcctttagatatggtggggccgaagggacaagtggtcc

SEQ ID NO: 464353 - DNA, 503 bp, Homo sapiens; identical to SEQ ID NO: 445162
  misc_feature: HEFZJCU01ETUUU.21.70.G04.1.454.heavy.3.raw

SEQ ID NO: 464354 - DNA, 519 bp, Homo sapiens; identical to SEQ ID NO: 445330
  misc_feature: HEFZJCU01EZ6EC.7.78.H01.1.454.heavy.3.raw

SEQ ID NO: 464355 - DNA, 518 bp, Homo sapiens; identical to SEQ ID NO: 447436
  misc_feature: HEFZJCU01CH4R7.13.76.G10.1.454.heavy.3.raw

SEQ ID NO: 464356 - DNA, 484 bp, Homo sapiens; identical to SEQ ID NO: 449066
  misc_feature: HEFZJCU01D2Z1W.52.4.A04.1.454.heavy.3.raw

SEQ ID NO: 464357 - DNA, 530 bp, Homo sapiens
  misc_feature: HEFZJCU01D74QO.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattgggagtgggtggcagttgtttcatctgagggcagtgttcaatggtatactgacgccgtgaagggccgattcaccatctccagagacaactccaggaacacaatgtatttggacctgaacagcctaagtcctgaggacacgggtgtatactactgtacgaaggaggggggaaccagcgggagttccaagtactcctttgacgtctggggccg

SEQ ID NO: 464358 - DNA, 500 bp, Homo sapiens; identical to SEQ ID NO: 444864
  misc_feature: HEFZJCU01DOF3K.9.30.C08.1.454.heavy.3.raw

SEQ ID NO: 464359 - DNA, 477 bp, Homo sapiens; identical to SEQ ID NO: 444659
  misc_feature: HEFZJCU01CX99C.16.10.A10.1.454.heavy.3.raw

SEQ ID NO: 464360 - DNA, 410 bp, Homo sapiens
  misc_feature: HEFZJCU01BBWGG.3.41.D08.1.454.heavy.3.raw
agacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactggggccgaggggaccctggtcaccgtctcctcagcttccaccaagggcccatcggtcttccccctggcgccctgctccaggagcacctctgggggcacagcggccctgggctgcctggtcaaggactacttccgagtgcgtct

SEQ ID NO: 464361 - DNA, 505 bp, Homo sapiens
  misc_feature: HEFZJCU01EEB7F.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctgggccagggaa

SEQ ID NO: 464362 - DNA, 516 bp, Homo sapiens
  misc_feature: HEFZJCU01B11KO.52.53.E09.1.454.heavy.3.raw
cgcagtacgacacgaccggtgctcgatttagagagagtgtgttgggtttgggtctgggagaggagcccagcactgggattccgaggtgtttccattcagtgatctgcactgaacacagaggactcgccatggagtttgggctgagcgtggttttccttgtagctatttaaaaggtgtccagtgtggagtgcaggtggtggagtctgggggaggcttggtccagcctggtggttccctgagactctcctgtgcagcctctggattctccgtcagtagcaactacatgagctgggtccgccaggctccagggaagggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctagttactgtgcgagagaacccagggggcggagcagccccgtaacttctggggaccg

SEQ ID NO: 464363 - DNA, 506 bp, Homo sapiens
  misc_feature: HEFZJCU01A29I8.48.34.D01.1.454.heavy.3.raw
agtatacatacacgaccggtgctcgatttagatcgtctgtgttgggtttggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactacttcctatgtatact

SEQ ID NO: 464364 - DNA, 488 bp, Homo sapiens; identical to SEQ ID NO: 444651
  misc_feature: HEFZJCU01CJIXN.16.67.G01.1.454.heavy.3.raw

SEQ ID NO: 464365 - DNA, 526 bp, Homo sapiens
  misc_feature: HEFZJCU01BD9K1.9.43.D10.1.454.heavy.3.raw
tgatacgtctcacgaccggtgctcgatttagactagcagtaaggggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccaggggaaggggctggaatgggtctcagttattcataccgacggtaccatatatgacgcagactccgtgaagggccgattcaccatcctccagagaccattccaagaacaccctatatcttcaaatagaacaacctgagagtcgaagacacggccgtatattactgtgcgagacatgacttcggtcgaccccgtggggccgagggaacccgtggtcaccgtctcctca

SEQ ID NO: 464366 - DNA, 528 bp, Homo sapiens
  misc_feature: HEFZJCU01DM8HU.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttccccctggtcgcctcg

SEQ ID NO: 464367 - DNA, 530 bp, Homo sapiens
  misc_feature: HEFZJCU01EYE2G.52.16.B05.1.454.heavy.3.raw
cgcagtacgacacgaccggtgctcgatttagagctcacgtaagggtagagctcacgtaagggggctctgggagacgagcccagcactggaagtcgccggtgtttccattcggtgatcatcagtgaacacagaggactcaccatggagtttgggctgacctgggttttcctcgttgctcttttaagagatgtccagtgtcaggtgcacctggtggagtctgggggaggcgtggtccagcctgggaagtccctgagactctcctgtagagactctggaatctacttcagtacttatggtctacattgggtccgccaggctccgggcaagggcctggggtgggtggcggtagtcacatatgaaagaaacaaaaagtactacgcagactccgtgaagggccgattcaccatctccagagacaactccaagaacacggtctatctacaaatgaatagcctcgtaactgcggacacggctgtttactactgtgcgacaggggcccgtcatatcaggaggactctactacttgtacg

SEQ ID NO: 464368 - DNA, 413 bp, Homo sapiens; identical to SEQ ID NO: 444933
  misc_feature: HEFZJCU01D9OZ4.51.60.F05.1.454.heavy.3.raw

SEQ ID NO: 464369 - DNA, 396 bp, Homo sapiens; identical to SEQ ID NO: 444469
  misc_feature: HEFZJCU01BLP7T.47.46.E02.1.454.heavy.3.raw

SEQ ID NO: 464370 - DNA, 481 bp, Homo sapiens
  misc_feature: HEFZJCU01CH5EC.4.37.D04.1.454.heavy.3.raw
agcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcaggggtcaccatgaccagggacacgtccatcagcacgtccatcagcacagcctacatggacctgagcggcctgacatctgacgacacggccgtatatttctgtgcgagggagt

SEQ ID NO: 464371 - DNA, 472 bp, Homo sapiens
  misc_feature: HEFZJCU01DDJDB.3.39.D06.1.454.heavy.3.raw
agacgcactccacgaccggtgctcgatttagtgacatctcgcagttctttgggttttggggggtccctgagactctcatgtacaggctctgagttcagcgtcactaaatactacatgagctgggtccgccaggctccagggaggggactggactgggtctccagtgttaacagcgatggaagtacatattatgcagactccgtgaagggccgattcaccatctccagagacaattccaagaacactctgtatcttcaaatgaacagcctgagagccgaggacacggccttctattactgtgcgagcgatcacgggcggagtctgatactttcttggggccaggggaaccctggtcaccgtctcctcagcctccaccaagggcccatcggtcttcccctgcgcctgctccagagcacctccgagagcacagcggccctgggctgcctggtcaggactacttccgagtgcgtct

SEQ ID NO: 464372 - DNA, 515 bp, Homo sapiens
  misc_feature: HEFZJCU01BRR54.21.70.G04.1.454.heavy.3.raw
tcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgtcgagacatagtggtattggctactcgccctattacggtatggacgtctggggccaagggaccgcagtcaccgtctcctcagcctccaccaagggcccatcggtcttcccctggcgccctgctccaggagcgacctccgagagca

SEQ ID NO: 464373 - DNA, 507 bp, Homo sapiens
  misc_feature: HEFZJCU01DCUJY.51.56.F01.1.454.heavy.3.raw
cgatcgtatacacgaccggtgctcgatttagcagacgtctgaacacacaaagggggagcatcacccagcaaccacatctgtcctctagagaaccccctgagagccccgctcctcaccatggactggacctggaggatcctcttcttggtggcagcagccacaagagcccaatcccaggtgcaggtggtgcagtctggggctgaggtgaagaagcccggggcctcagcgaaggtctcctgcaagacctctggctacaccttcagtggcaacaacgtccactgggtgcgccaggcccctggacaaggacttgagtggatgggatggtttagtctgagaactggtgccgcaaattatgcacaggagtttcggggcagggtcgtcatgaccggggacacgtccatcgccacgacttacatggaactgaccagtctgacatttgacgacacggccgtctattactgtgcgacagaagcggcgacagaggttcgcttactggttcgaggctcc

SEQ ID NO: 464374 - DNA, 523 bp, Homo sapiens
  misc_feature: HEFZJCU01BRI81.48.33.C11.1.454.heavy.3.raw
  modified_base (467)..(467): a, c, t, g, unknown or other
  modified_base (514)..(514): a, c, t, g, unknown or other
agtatacatacacgaccggtgctcgatttagagtgagctcgttgggtttgggctgagcgtgcgttttctaagtgactatttttaaaggtgtccagtgtgaggtgcaactattggagtctgggggtggcctggtgcagccgggggggtccctgagactctcttgtgcagcctctggattcagctttagtaattatgccatgagctgggtccgccaggctccagggaaggggctggagtggatttcatctattagtggtagtggtgttaccacatactacgcagactccgtgaagggccgattcatcatctccagagacagttccaggaacacactggatttgcaaatgaacagcctgagagccgaggacacggccctatattactgtgcgaaatcccaatgatagtagtggtttttctttcgttcttttgaccactggggccagggatccctgctcaccgtctcctcngcctccaccaagggccatcggtcttccccctgcgccctgctccaggngcacctccg

SEQ ID NO: 464375 - DNA, 482 bp, Homo sapiens; identical to SEQ ID NO: 444503
  misc_feature: HEFZJCU01B20E4.7.10.A10.1.454.heavy.3.raw

SEQ ID NO: 464376 - DNA, 543 bp, Homo sapiens; identical to SEQ ID NO: 446584
  misc_feature: HEFZJCU01ARSGB.16.39.D06.1.454.heavy.3.raw

SEQ ID NO: 464377 - DNA, 524 bp, Homo sapiens; identical to SEQ ID NO: 446401
  misc_feature: HEFZJCU01BQD2K.3.82.H05.1.454.heavy.3.raw

SEQ ID NO: 464378 - DNA, 511 bp, Homo sapiens
  misc_feature: HEFZJCU01C5HN1.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggtcggtgaactactggggccagggcaccctggtcaccgtctcctcagcttccaccaagggcccatcggtcttcccctggcgccctgctccaggagcacctctgggggcacgagcggccctgggctgcctggtcaaggactactcccata

SEQ ID NO: 464379 - DNA, 482 bp, Homo sapiens; identical to SEQ ID NO: 444503
  misc_feature: HEFZJCU01C14Z7.7.10.A10.1.454.heavy.3.raw

SEQ ID NO: 464380 - DNA, 510 bp, Homo sapiens; identical to SEQ ID NO: 445542
  misc_feature: HEFZJCU01BKK0P.16.21.B10.1.454.heavy.3.raw

SEQ ID NO: 464381 - DNA, 481 bp, Homo sapiens
  misc_feature: HEFZJCU01DHYLZ.11.23.C01.1.454.heavy.3.raw
cgagagataccacgaccggtgctcgatttagtacacgtgattagggattgggggcagggtgtacacctgtggttctcggggctgccctttggctttggagatggttttctcgatggggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctggcaccctcctccaagagcacctctggggcacagcgccctggctgcctggtcaaggactacttccgtatctctcg

SEQ ID NO: 464382 - DNA, 532 bp, Homo sapiens
  misc_feature: HEFZJCU01BGS39.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacattattccgcagactccgtgagggggccgattcaccatctccagagacaactctaagaacacgctgtttcttcaaatgaacagcctgagagccgatgacacggccgtgtattactgtgcgagagatgggggcccacggaacgttacctacgctatcggacgtctggggccaagggaccac

SEQ ID NO: 464383 - DNA, 505 bp, Homo sapiens; identical to SEQ ID NO: 447124
  misc_feature: HEFZJCU01CTMLU.10.88.H11.1.454.heavy.3.raw

SEQ ID NO: 464384 - DNA, 512 bp, Homo sapiens
  misc_feature: HEFZJCU01C33MG.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatgaacagcctgaagaccgaggacacagccgtctatttactgtgttagggtagttttacgtatttttggt

SEQ ID NO: 464385 - DNA, 487 bp, Homo sapiens
  misc_feature: HEFZJCU01BNLN7.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctccgagagcacagcggccctgggctgcctggtcaaggctactcctacgtgagct

SEQ ID NO: 464386 - DNA, 521 bp, Homo sapiens
  misc_feature: HEFZJCU01B98JT.13.76.G10.1.454.heavy.3.raw
tcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccgagggaaccg

SEQ ID NO: 464387 - DNA, 502 bp, Homo sapiens
  misc_feature: HEFZJCU01D67OW.53.14.B03.1.454.heavy.3.raw
cgcgtatacacacgaccggtgctcgatttagtgtgagtagttccgcgggcctggcgcacccaatggatagcatgggtactgagggtgtatccagaagcctggcaggaaaccttcactgaggccccaggcttcttcgcctcagccccagactgcacaagctggacctgggagtgggcacctgtggctgctgccaccaaaagaggatcctccaggtccagtccatggtgaggcgttgtgctctgggggcttctgaggagggatgtggttgttgggtcagcgctggcaatggtgacagacactattcacagaagttccagggcagagtccaccatcaccagggacacatccgcgagcacagcctacatggaactgagcagcctgagatctgaagacacgggtgtatattactgtgcgagagggaagtgggatattgtagatgcgccaggtgcccggccggccccctactttgactacgtgggggccggggaaccctggtcaccgt

SEQ ID NO: 464388 - DNA, 498 bp, Homo sapiens
  misc_feature: HEFZJCU01ENRIE.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgtttctgcaaatgaacagcctgagaattgaggactcgggtatatactactgtgcccgtgacccctgactgataaaccggactggttcgaccctggggccagggaaccctggtcaccgtctcct

SEQ ID NO: 464389 - DNA, 524 bp, Homo sapiens; identical to SEQ ID NO: 445902
  misc_feature: HEFZJCU01BO8VV.9.78.H01.1.454.heavy.3.raw

SEQ ID NO: 464390 - DNA, 502 bp, Homo sapiens
  misc_feature: HEFZJCU01CE889.51.38.D05.1.454.heavy.3.raw
cgatcgtatacacgaccggtgctcgatttagtatctgatagttgggtttggggtctgggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccaggcctgggaggtccctgagactcgcctgtaaaccgtccggattcaccttcagtaactatgcaatgcactgggtccgccaggctccaggcaaggggctggactgggtggcaggcatatcattttaatggaagcaagaagtactatgcagactccgtgaagggccgattcaccatctccagagacagttccgatgacacagtctatctacacatgagcagtgtgagacctgacgacacggctcttttttactgttgcgccaggaagcaggtggctggcca

SEQ ID NO: 464391 - DNA, 379 bp, Homo sapiens; identical to SEQ ID NO: 444450
  misc_feature: HEFZJCU01D43FK.47.77.G11.1.454.heavy.3.raw

SEQ ID NO: 464392 - DNA, 507 bp, Homo sapiens
  misc_feature: HEFZJCU01C0RXL.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatgggcactacatattattctgactccgtgaagggccggttcaccctctccagagacacttccaacaacatctgtatcttcacatgcacaatctgagagtcgacgacacggccacctattattgtgcgcgacatgactacgctcaattctggggccaggggacg

SEQ ID NO: 464393 - DNA, 490 bp, Homo sapiens
  misc_feature: HEFZJCU01DB9S5.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttatactgtgcgagagtctggggtgctacgagtactggtacttcgatctctgggccgtggcacctgctgactgtctcctcagcctccaccaagggcccatcggtcttcccctggcgccctgctccaggagcacctccgagagcacagcggccctggctgcctggtcaaggctac

SEQ ID NO: 464394 - DNA, 501 bp, Homo sapiens
  misc_feature: HEFZJCU01CKDQN.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacaagcctacatggaactgaggagcctgagatctgacgacacggccgtatatttctgcgcgagagacgtaaagtagacgtggtattccggggggacacatg

SEQ ID NO: 464395 - DNA, 383 bp, Homo sapiens
  misc_feature: HEFZJCU01A1GZR.47.60.F05.1.454.heavy.3.raw
agctcacgtacacgaccggtgctcgatttagtacgtcatcagggaaagggactggagtggattggctatctgtattacggtgggagttcaaacttcaacccctccctcaagagtcgagtcaccatttcaggagacacgtccaagaatcaggtctccttgaacctgaggcagacgaccccagcggacacggccgtctattattgtgcgagaggtcttcttggatgacgatgccctggacgactggggccagggagtccttgtcaccgtctcctcagcctccaccaagggcccatcggtcttccccctggcaccctcctccaagagcacctctgggggcacagcggcctgggctgcctggtcaaggactacttcctacgtgagct

SEQ ID NO: 464396 - DNA, 512 bp, Homo sapiens
  misc_feature: HEFZJCU01C5DDJ.53.39.D06.1.454.heavy.3.raw
cgcgtatacacacgaccggtgctcgatttagtgacatctcgcagttctttggggggatctcatgtgcaagaaaatgaagcacctgtggttcttcctcctgctggtggcggctcccagatgggtcctgtcccagctgcagctgcaggagtcgggcccaggactggtgaagccctcggagaccctgtccctcacctgcactgtctctggtgcctccatcagcacaagtaatcactactggggctggctccgccagcccccagggaagggctggagtggattgggagtatgtattatggtggggccacctactacaacccgtccctcaagagtcaagtcaccatatccgtagaccacgtccagcaaccagttctccctgaggctgtcctctgtgaccgccgcagacacggctgtctattactgtgcgagacatgtggggccagtgggagtggtcgtacaactggttcgaccctggggccagggaaccctggtcaccgtctcctcagcctccaccg

SEQ ID NO: 464397 - DNA, 379 bp, Homo sapiens; identical to SEQ ID NO: 444450
  misc_feature: HEFZJCU01D65Z3.47.77.G11.1.454.heavy.3.raw

SEQ ID NO: 464398 - DNA, 519 bp, Homo sapiens
  misc_feature: HEFZJCU01EGRPA.49.41.D08.1.454.heavy.3.raw
agtcgagagacacgaccggtgctcgatttagtcacgcgagaaagggaaaggggatgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatgagcagtagtaattactactggggctgggtccgccagccccagggaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctcagcct

SEQ ID NO: 464399 - DNA, 541 bp, Homo sapiens
  misc_feature: HEFZJCU01AG5DO.13.65.F10.1.454.heavy.3.raw
tcacgtactacacgaccggtgctcgatttagctacgctctaagggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtctggaggaggcttggtccagccgggggggtccctgagactctcatgtgcggcctctgggctcaccgtcaacaccaactacatgagctgggtccgccaggctccagggaagaggccggagtgggtctcagttatttatgtcgacggtgccacattctacgcagactccgtgaggggccggttcaccatctccagagacaattcccaagaacacggtgtatcttcaaatgaacgacctgagagtcgaggacacggccgtctattactgtgcgaaagatgcagagagggcccccgtaatgggggcctggtggagggttcttctttgactgctggggccaggggaaccct

SEQ ID NO: 464400 - DNA, 518 bp, Homo sapiens; identical to SEQ ID NO: 444718
  misc_feature: HEFZJCU01DPN7G.9.34.D01.1.454.heavy.3.raw

SEQ ID NO: 464401 - DNA, 522 bp, Homo sapiens
  misc_feature: HEFZJCU01EUCHV.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggacggttttggggcgcggactcctcttgagatctggggccagggggacaagtggtcaccgtctcttcag

SEQ ID NO: 464402 - DNA, 536 bp, Homo sapiens
  misc_feature: HEFZJCU01CX0RP.14.26.C04.1.454.heavy.3.raw
cgtctagtaccacgaccggtgctcgatttagtctagcgactttgggtttgggggtctcagagaggagccttagccctggactccaaggcctttccacttggtgatcagcactgagcacagaggactcaccatggagttggggctgagctgggttttccttgttgctattttagaaggtgtccagtgtgaggtgcagttggtggactctgggggaggcttggtccagcctggggggtccctgagactctcctgtgcagcctctggattcacctttagtaaatattggatgatgtgggtccgccaggctccagggaaggggctggagtgggtggcccacataaacgaagacggaattaagaaatactatctggactctgtgaagggccgattcaccatctccagagacaacgccgagaactcactgtatctgcagatgaacagcctgagagccgaagacacggccgtgtattactgtacgagagacgttgggtttaaaacttttgactattggggccagggaaccctggtcaccgtct

SEQ ID NO: 464403 - DNA, 521 bp, Homo sapiens
  misc_feature: HEFZJCU01B22YV.48.56.F01.1.454.heavy.3.raw
agtatacatacacgaccggtgctcgatttagcagacgtctgaacacacaaagggggctctgagagaagagcccagccctgggattttcaggtgttttcatttggtgatcaggactgaacagagagaactcaccatggagtttgggctgaggtggctttttcttgtggcgattttaagaggtgtccagtgtgaggtgaagttgttggagtctgggggaggcttggtaaagccggggggctccctgacactctcctgtgtaacctctggcttcgactttaagtcttatgccatgacctgggtccgccaggctccagggaaggggctggagtgggtctcaacaattagtgttagtggtgacgacagatactacgcagactccgtggagggccgcttcaccatctccagagacagcccaagaacacactgtctctggagatgatcaacctgagagccgacgacacggcagtgtattactgcgcgaaagaatcaagtgggctcatctcgggcggccgacccacgtc

SEQ ID NO: 464404 - DNA, 509 bp, Homo sapiens
  misc_feature: HEFZJCU01A52E5.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctcattccgttcatctgaatactgggccagggaacctggtcgtccg

SEQ ID NO: 464405 - DNA, 487 bp, Homo sapiens
  misc_feature: HEFZJCU01APVSR.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaaggcccatcgtcttcccctggcgccctgctccaggagcacctccgagagcacagcggccctgggctgcctggtcaaggactacttcccatactcgta

SEQ ID NO: 464406 - DNA, 493 bp, Homo sapiens; identical to SEQ ID NO: 449281
  misc_feature: HEFZJCU01EU6FO.13.86.H09.1.454.heavy.3.raw

SEQ ID NO: 464407 - DNA, 392 bp, Homo sapiens; identical to SEQ ID NO: 446670
  misc_feature: HEFZJCU01DF0A2.53.60.F05.1.454.heavy.3.raw

SEQ ID NO: 464408 - DNA, 501 bp, Homo sapiens; identical to SEQ ID NO: 452739
  misc_feature: HEFZJCU01DWIHS.7.85.H08.1.454.heavy.3.raw

SEQ ID NO: 464409 - DNA, 524 bp, Homo sapiens
  misc_feature: HEFZJCU01C71CJ.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttggttctgggggccaggggaccctggtcatcgtctccccagcctccaccaagggcccatcggtcttccccctggcg

SEQ ID NO: 464410 - DNA, 507 bp, Homo sapiens; identical to SEQ ID NO: 444486
  misc_feature: HEFZJCU01D2KN7.4.67.G01.1.454.heavy.3.raw

SEQ ID NO: 464411 - DNA, 514 bp, Homo sapiens
  misc_feature: HEFZJCU01D0TKZ.52.28.C06.1.454.heavy.3.raw
cgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggataccccataaccggctactacttacactgggtgcgacaggcccctggacaagggcttgagtggatggggtggaacaatcccaacagtggaggcaccggtcgcacagaatatgcgcggaagtttcagggcagggtcaccatgaccagcgacaggtccactaacacagcctacatggagctaagtagactgacatctgacgacacggccgtctattattgtgtgagagaggacccgatgaccctcgaacatggacgtctggggccg

SEQ ID NO: 464412 - DNA, 479 bp, Homo sapiens
  misc_feature: HEFZJCU01ADOMK.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttcccctcggcaccctcctccaagagcacctctgggggcacagcggccctgggctgcctggtcaagggactactttccgagtagtaca

SEQ ID NO: 464413 - DNA, 510 bp, Homo sapiens
  misc_feature: HEFZJCU01BZUQE.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggcttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatacctactttgactactggggccg

SEQ ID NO: 464414 - DNA, 525 bp, Homo sapiens
  misc_feature: HEFZJCU01B6ZKV.48.57.F02.1.454.heavy.3.raw
agtatacatacacgaccggtgctcgatttagctcgatatagttgggtttggggagtgactcctgtgccccaccatggacacactttgctccacgctcctgctgctgaccatcccttcatgggtcttgtcccagatcaccttgaaggagtctgggccaacgctggtgaaacccacacagaccctcacgctgacctgcaccttctctgggttctcactcaccactgatgaggtgggtgtggcctggatccgtcagcccccgggaaaggccccggagtggcttggattgatttatggggatggtgacaagcgttacagtgcatctctgaagaccagactctccatcaccaaggacacctccaagaacgaggttgtcctttccttggccaacatgcaccctgtggacacggccacttatttttgtacacacaccatcttgacgactggggatgcttttcatttctggggccaggggaccgtggtcgccgtgtctacagcctccaccaagggcccatcggtcttcccctc

SEQ ID NO: 464415 - DNA, 505 bp, Homo sapiens; identical to SEQ ID NO: 461646
  misc_feature: HEFZJCU01A5XFQ.17.25.C03.1.454.heavy.3.raw

SEQ ID NO: 464416 - DNA, 514 bp, Homo sapiens
  misc_feature: HEFZJCU01ERQWJ.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccggacaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaacgggcccatccggtcctttccccctggccgccctgcctccaggacg

SEQ ID NO: 464417 - DNA, 513 bp, Homo sapiens; identical to SEQ ID NO: 446452
  misc_feature: HEFZJCU01A5NZQ.17.33.C11.1.454.heavy.3.raw

SEQ ID NO: 464418 - DNA, 400 bp, Homo sapiens; identical to SEQ ID NO: 445493
  misc_feature: HEFZJCU01B0JCD.13.4.A04.1.454.heavy.3.raw

SEQ ID NO: 464419 - DNA, 541 bp, Homo sapiens
  misc_feature: HEFZJCU01DJUWP.48.44.D11.1.454.heavy.3.raw
agtatacatacacgaccggtgctcgatttagcgcagtacgaagggggggagaggagctccagccttgggactcccagctgtctccactcggtgatcggcactgaatacaggagactcaccatggagtttgggctgagctgggttttccttgttgctattttaaaaggtgtccagtgtgaggtgcagttggtgcagtccgggggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacaacggccgtttattattgtacttctgaggtgacgggaaccgcgtggctattggggccagggaaccct

SEQ ID NO: 464420 - DNA, 555 bp, Homo sapiens
  misc_feature: HEFZJCU01A82YU.49.73.G07.1.454.heavy.3.raw
agtcgagagacacgaccggtgctcgatttagctctacgctcagggggctctgggagacgagcccagcactggaagtcgccggtgtttccattcggtgatcatcactgaacacagaggactcaccatggagtttgggctgagctgggttttcctcgctgctcttttaagagacgtccactgttttgtgggcctggtggagtctggggggggctggtccagcccgggaggtccctcagactctcctgtacagacccgacatcttacgtcaggattaataatgtacactggatccgccaggccccaggcaaggggctggagtgggtggcattggtgactcatgtggaagacagaaaattgtacgcagactccgtgaggggccgattcatcatctccaagactactccaagaatacggtgtatcttcaatgaatggcctcgttttgcggacacggctgtttattattgtgtcgacacggggggcccccctttccgtacggtacggcgatcgataactacctttacgtacctacgtacggggccgacgggaacccgtacc

SEQ ID NO: 464421 - DNA, 517 bp, Homo sapiens
  misc_feature: HEFZJCU01CINUH.52.36.D03.1.454.heavy.3.raw
cgcagtacgacacgaccggtgctcgatttagctgcgtcacgatctctcttggggagctctgggagaggagctccagccttgggattcccagctgtctccactcggtgatcggcactgaaaacaggagactcattatggagtttgggctgagctgggttttccttgttgctattttaaaaggtgtccagtgtgagatgcagctggtggagtctggggaggcttggtccagcctggggggtccctgaaactctcctgtacagcctctgggttccccttcagtggcactgctatgcactgggtccgccaggtttccgggaaagggctggagtgggttggccgcatcagaggcaaggcaaaaagtcacgcgacggcatatgctgcgtcggtgaaaggcaggttcaccatctccagagatgattcagataacacggcgtatctgcaaatgaacaacctagaaaccgaagacacgccgtgtattattgtagtagacagttcggggggttctgaagtgaccacg

SEQ ID NO: 464422 - DNA, 504 bp, Homo sapiens
  misc_feature: HEFZJCU01BPDS8.40.55.E11.1.454.heavy.3.raw
tctagcgactcacgaccggtgctcgatttagcactcgcacgttgggtttgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtgggccgaagggacataggtcaccgtc

SEQ ID NO: 464423 - DNA, 524 bp, Homo sapiens
  misc_feature: HEFZJCU01DQJYM.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggccaggggaccctggtcatcgtctccccagcctccaccaagggcccatcggtcttccccctggccg

SEQ ID NO: 464424 - DNA, 531 bp, Homo sapiens; identical to SEQ ID NO: 446857
  misc_feature: HEFZJCU01DFWQ6.7.78.H01.1.454.heavy.3.raw

SEQ ID NO: 464425 - DNA, 430 bp, Homo sapiens; identical to SEQ ID NO: 444675
  misc_feature: HEFZJCU01C5PU4.40.34.D01.1.454.heavy.3.raw

SEQ ID NO: 464426 - DNA, 516 bp, Homo sapiens
  misc_feature: HEFZJCU01EP7AT.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactgggccggggaaccctggtcgccgtctcctcagcctccaccaagggcccatcggtcttccccctggcacctcctccaagagcacctctgggggcacagcggccctgggctgcctggtcaaggactacttccagacgatca

SEQ ID NO: 464427 - DNA, 534 bp, Homo sapiens
  misc_feature: HEFZJCU01BM3WF.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaaagtatggctgtgtttattggggccagggagcctggtccacg

SEQ ID NO: 464428 - DNA, 491 bp, Homo sapiens; identical to SEQ ID NO: 444592
  misc_feature: HEFZJCU01CHLV0.11.26.C04.1.454.heavy.3.raw

SEQ ID NO: 464429 - DNA, 517 bp, Homo sapiens
  misc_feature: HEFZJCU01CC1FO.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccaagagcacctctgggggcacagcggccctgggctgcctgtcaaggactactcctagagacacg

SEQ ID NO: 464430 - DNA, 518 bp, Homo sapiens
  misc_feature: HEFZJCU01DRRTK.13.39.D06.1.454.heavy.3.raw
tcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactggagtggattgggcttatcaatgccaggtgggggcaccagctacaaccctccctcaagagccgcgtcaccatttcagtagacacgtccaagaaccagctctccctgaagctgagttctgtgaccgccgcagacacggccgtgtattactgtgcgcgacaggtggacgtcgtggggccaaaggggaccacggtcaccgtctcctcacgcctccaccaacggggccccagttcc

SEQ ID NO: 464431 - DNA, 523 bp, Homo sapiens; identical to SEQ ID NO: 446270
  misc_feature: HEFZJCU01EX4CW.12.40.D07.1.454.heavy.3.raw

SEQ ID NO: 464432 - DNA, 499 bp, Homo sapiens
  misc_feature: HEFZJCU01DZIBS.13.33.C11.1.454.heavy.3.raw
tcacgtactacacgaccggtgctcgatttagagtgagctcgttgggtttgggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaataagaattgcaaacgatgcttttgatatgtggggccaaggg

SEQ ID NO: 464433 - DNA, 379 bp, Homo sapiens; identical to SEQ ID NO: 444450
  misc_feature: HEFZJCU01B4E2R.47.77.G11.1.454.heavy.3.raw

SEQ ID NO: 464434 - DNA, 519 bp, Homo sapiens
  misc_feature: HEFZJCU01A9P1U.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctatacccacctcagtcagctggttcgacccctggggccagggaaccctggtcaccgtctcctcagcctccaccaagggcccatcggtcttccccctggcaccctcctccaagagcacctctgggggcacagcggccctgggctgcctggtcaaggactacttccgagtagtac

SEQ ID NO: 464435 - DNA, 489 bp, Homo sapiens
  misc_feature: HEFZJCU01CDC4L.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggcacctcctccaagagcacctctgggggcacagcggccctgggctgcctggtcaggactacttccgagtgcgtct

SEQ ID NO: 464436 - DNA, 548 bp, Homo sapiens
  misc_feature: HEFZJCU01D2JT7.48.3.A03.1.454.heavy.3.raw
  modified_base (487)..(487): a, c, t, g, unknown or other
agtatacatacacgaccggtgctcgatttagagagcgtcacagggggagagaggagcccagccctgggattttcaggtgttttcacttggtgatcaggactgaacagagagaactcaccatggagtttgggctgagctggctttttcttctggccattttaaaaggtgtccagtgtgaggagcagttgtcggaatctgggggagacctggtacagccgggggggtccctgacactctcctgtgtggcctctggattcatttttagcaaccacgccatttacctgggtccgccagagtccagggaagggactggacggagtcgcgggtataagtggttttagtggaagtagattatacgcagagtccgtaagggccggttcaccatctccagagacaattccaagaacacggcatatctacaaatgaacaacctgggcgccgaagacacggccgtctattactgtgcgagatcctctactagtgccgngaggtactttgaactctggggtcagggaaccctggtcaccgtctcctcagcctccaccaac

SEQ ID NO: 464437 - DNA, 538 bp, Homo sapiens
  misc_feature: HEFZJCU01EA6IN.40.27.C05.1.454.heavy.3.raw
  modified_base (525)..(525): a, c, t, g, unknown or other
tctagcgactcacgaccggtgctcgatttagacgcgatcgaagggtttggggggaagaggaagactgacggtcctgtcccagttgcagttgcaggagtcgggcccaggactggtgaagacttcggagaccctgtccctcacgtgcactgtctctggtggctccatccgcaatcgtcgattctattggggctgggtccgccggcccccagggaaggggctggagtggattgcgagcatatattatgatgagagcgccctctacaaccccccccctctacaacccctccctcaagagtcgggtcaccatatctatagacacgtccaacagtcaattctccctggacttgacctctgtgaccgccgcagacacggctgtatattcctgtgcgacccacggaggggatggccccaaatctgcctactttgaccactggggccagggaacccttggtcaccgtctcctcagcctccaccaagggcccatcggtcttccccctggccgccctgctccagagcacctccgangcacagcggccct

SEQ ID NO: 464438 - DNA, 500 bp, Homo sapiens; identical to SEQ ID NO: 445807
  misc_feature: HEFZJCU01ELJEX.40.81.H04.1.454.heavy.3.raw

SEQ ID NO: 464439 - DNA, 514 bp, Homo sapiens; identical to SEQ ID NO: 447635
  misc_feature: HEFZJCU01CKEGP.4.57.F02.1.454.heavy.3.raw

SEQ ID NO: 464440 - DNA, 519 bp, Homo sapiens; identical to SEQ ID NO: 452709
  misc_feature: HEFZJCU01EVF02.3.82.H05.1.454.heavy.3.raw

SEQ ID NO: 464441 - DNA, 541 bp, Homo sapiens
  misc_feature: HEFZJCU01EB7L8.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgagggaagggcctggagtggatctcacttatttatagtggtggtaccacatactacacagactccgtgaagggccgattcaccatctcagaagacaattccaggaacacattgtatcttcaaatgaataacctgagagccgagacacggccatgtattactgtgtggggcatttacttgaccccgtcggggacccggggtaaccgtcggtccgtccgtcctcccccacccctccaaccc

SEQ ID NO: 464442 - DNA, 537 bp, Homo sapiens
  misc_feature: HEFZJCU01DR9OU.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactggctcggccctggggcccgggaaccctggtcaccgtctcctcagcctccaccaagggcccatcggtcttccccctcggcaccctcctccaagacg

SEQ ID NO: 464443 - DNA, 536 bp, Homo sapiens
  misc_feature: HEFZJCU01ENT56.18.33.C11.1.454.heavy.3.raw
tacgagtatgcacgaccggtgctcgatttagagtgagctcgttggggttttgggggggagaggagcccacgcgactgggattccggaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccttgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctgggggccgggggaaccctggtcaccgtctccccaccctccaccg

SEQ ID NO: 464444 - DNA, 499 bp, Homo sapiens
  misc_feature: HEFZJCU01BC3T7.51.23.C01.1.454.heavy.3.raw
cgatcgtatacacgaccggtgctcgatttagtacacgtgattagggattgggggcatcacataacaaccagattcctcctctaaagaagcccctgggagcacagctcatcaccatggactggacctggaggttcctctttgtggtggcagcagttacaggtgtccattcccaggtccagctggtgcagtctggggctgaggtgaagatgcctgggtcctcggtgaaggtctcctgcaagtattctggaggcaccttcagcaactatggtatcagctgggtgcgacaggcccctggacaagggcttgagtggatgggaagggtcacccctatatttgatgtagcagactctgcacagaagttccagggcagaataacaattacggcggacaatccacgaccacagcctacatggagctgagcagcctgagatctgaggacacggccctttattactgtgcgagtatttaccgtgggggtcacggcggatatatcgccata

SEQ ID NO: 464445 - DNA, 491 bp, Homo sapiens
  misc_feature: HEFZJCU01AC0X7.49.17.B06.1.454.heavy.3.raw
  modified_base (465)..(465): a, c, t, g, unknown or other
agtcgagagacacgaccggtgctcgatttagtcgatagtgaaggggtctgggagacgagcccagcactggaagtcgccggtgtttccattcggtgatcatcactgaacacagaggactcaccatggagtttgggctgagctgggttttcctcgttgctcttttcagaggtgtccagtgttatgtgcagctggtggagtctgggggaggcgtggtccagcctgggaggtccctgagactcgcctgcaaaccgtccggattcaccttcagtaattatgcaatgcactgggtccgccagactccaggcaaggggctgcactgggtggcggccatatcatttgatggaagcaagaaatactatgcagactccgtgaggggccgattcaccatctccagagacagttccgatgacacagtgtatctgcaaatgaacagcctgagacctgaggacacggctctcttttacngttgcgccaggagcagtggctggccg

SEQ ID NO: 464446 - DNA, 495 bp, Homo sapiens
  misc_feature: HEFZJCU01CQPF6.49.52.E08.1.454.heavy.3.raw
agtcgagagacacgaccggtgctcgatttagtcgagctctcccgcgggtctcagagaggtgccttagccctggattccaaggcatttccacttggtgatcagcactgaacacagaggactcaccatggaattggggctgtgctgggttttccttgttgctattttagaaggtgtccactgtgacgtgcagctggtggagtctgggggagccttggttcagcctggagggtccctgagactctcctgtgcagcctctggattcagcttcagtagttatgagatgaactgggtccgccaggctccagggaaggactggagtgggtttcatacattagtcggagagtcaacaccgtattctacacagactctgtcaggggccgattcaccatctccagagacaacgccaagaactcactgtatctccaaatgaacagcctgagagtcgaggacacggctgtctattactgtgcgagagatcccaacagcggctggtta

SEQ ID NO: 464447 - DNA, 513 bp, Homo sapiens
  misc_feature: HEFZJCU01BIDJB.17.37.D04.1.454.heavy.3.raw
  modified_base (481)..(481): a, c, t, g, unknown or other
cgtagactagcacgaccggtgctcgatttagtagcatactgttgggtttgggggagccccagccctgggattcccagctgtttctgcttgctgatcaggactgcacacagagaactcaccatggagtttgggctgagctgggttttccttgttgctattttaaaaggtgtccagtgtgcggtgcagctggtggagtccgggggaggtttagttcagcctggggggtccctgagactctcctgtgcggcctctggattcaccttcagtagctactggatgcactgggtccgccaagctccagggaaggggctggtgtgggtctcacgtattgatactgatggcattaccacatcctacgcggactccgtgcagggccgattcaccatctccagagacaacgccaagaacacgctgtatctgcaaatgaacagtctgagagccgaggacacggctgtgtactactgtgcaagagttccccggnagctcgcccggtactcgtgggccagggaaccc

SEQ ID NO: 464448 - DNA, 531 bp, Homo sapiens
  misc_feature: HEFZJCU01C7G15.11.25.C03.1.454.heavy.3.raw
cgagagataccacgaccggtgctcgatttagtagtgtagatttgggtttgggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctcgtggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtcgtggggtccgaagggaccacc

SEQ ID NO: 464449 - DNA, 492 bp, Homo sapiens; identical to SEQ ID NO: 450124
  misc_feature: HEFZJCU01DQA85.4.57.F02.1.454.heavy.3.raw

SEQ ID NO: 464450 - DNA, 413 bp, Homo sapiens; identical to SEQ ID NO: 444933
  misc_feature: HEFZJCU01BYDRE.51.60.F05.1.454.heavy.3.raw

SEQ ID NO: 464451 - DNA, 479 bp, Homo sapiens
  misc_feature: HEFZJCU01DFTI8.19.67.G01.1.454.heavy.3.raw
tactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctggtggacagatcactggggccagggaaccctggtcaccgtctcctcagcctccaccaagggcccatcggtcttcccctggcgccctgctccaggagcacctccgagagcacagcggccctgggctgcctggtcaggactacttcccacgagagta

SEQ ID NO: 464452 - DNA, 510 bp, Homo sapiens
  misc_feature: HEFZJCU01AMYOD.10.53.E09.1.454.heavy.3.raw
catagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcgggccggattcaccatctccaagacaatttgaagaacacgctgtttctgcaatagaacagcctgagagctgaggacacggctgtgtattactgttcgtttggttctgtactcgtcggggaataccttc

SEQ ID NO: 464453 - DNA, 399 bp, Homo sapiens; identical to SEQ ID NO: 451078
  misc_feature: HEFZJCU01CLVGS.47.24.C02.1.454.heavy.3.raw

SEQ ID NO: 464454 - DNA, 491 bp, Homo sapiens
  misc_feature: HEFZJCU01DDLB4.19.53.E09.1.454.heavy.3.raw
tactctcgtgcacgaccggtgctcgatttagagagagtgtgttgggtttggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttccccctggcgccctgctccaggagcacctccgagagcacagcggccctgggctgcctggtcaaggactacttcccacgagagta

SEQ ID NO: 464455 - DNA, 495 bp, Homo sapiens
  misc_feature: HEFZJCU01DRVT3.14.25.C03.1.454.heavy.3.raw
cgtctagtaccacgaccggtgctcgatttagtagtgtagatttgggtttggggagacgaggcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctggagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgta

SEQ ID NO: 464456 - DNA, 486 bp, Homo sapiens
  misc_feature: HEFZJCU01A9XHO.53.15.B04.1.454.heavy.3.raw
  modified_base (476)..(476): a, c, t, g, unknown or other
cgcgtatacacacgaccggtgctcgatttagacagtatatatccgcgggggctctgggagaggagcccagcactagaagtcggcggtgtttccattcggtgatcagcactgaacacagaggactcagcatggagtttgggctgagctgggttttcctcgttgctcttttaagaggtgtccagtgtcaggtgcaactggtggagtctgggggaggcgtggtccagcctgggaagtcactgcgactctcctgtgcagcctctggattcagcttcagctcgtatgcgatgcactgggtccgccaggctccaggcaaggggctggagtgggtggcggttatttcacatgatggaagtcaggaatattatgcagactccgtgaggggccgattcaccatctcccgagacaattccaagaacacagtggatctgcaaatgagtagcatgagaggttggggacacggcggtgtattactgtgngaaggcttgg

SEQ ID NO: 464457 - DNA, 482 bp, Homo sapiens
  misc_feature: HEFZJCU01DL5BN.19.71.G05.1.454.heavy.3.raw
tactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtcccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagaggcccccatagacatgccacctcgtctctgtgcta

SEQ ID NO: 464458 - DNA, 500 bp, Homo sapiens
  misc_feature: HEFZJCU01B7TZR.17.10.A10.1.454.heavy.3.raw
cgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaattgataggctctatggactggacttcgtc

SEQ ID NO: 464459 - DNA, 507 bp, Homo sapiens
  misc_feature: HEFZJCU01DJT9N.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttccccctggcaccctcctccaacgagcacctctgggggcacagcggccctgggctgcctggtcaaggactacttcctacgtcgtat

SEQ ID NO: 464460 - DNA, 471 bp, Homo sapiens; identical to SEQ ID NO: 446080
  misc_feature: HEFZJCU01B5HGD.4.36.D03.1.454.heavy.3.raw

SEQ ID NO: 464461 - DNA, 510 bp, Homo sapiens; identical to SEQ ID NO: 453796
  misc_feature: HEFZJCU01DDWDP.16.71.G05.1.454.heavy.3.raw

SEQ ID NO: 464462 - DNA, 497 bp, Homo sapiens
  misc_feature: HEFZJCU01D8DYI.51.71.G05.1.454.heavy.3.raw
cgatcgtatacacgaccggtgctcgatttagtgtcgtcgcaagagagaggggctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttcccctggcaccctcctcc

SEQ ID NO: 464463 - DNA, 530 bp, Homo sapiens
  misc_feature: HEFZJCU01BS952.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtccttcccctggcgccctgctccaggagcaccctccgacgagcacagcggccctgggctgcctggtcaaggactacttccacg

SEQ ID NO: 464464 - DNA, 525 bp, Homo sapiens
  misc_feature: HEFZJCU01EHGV4.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctccttgacttctgggccatggaacccgtccg

SEQ ID NO: 464465 - DNA, 409 bp, Homo sapiens; identical to SEQ ID NO: 444519
  misc_feature: HEFZJCU01DWTJJ.3.41.D08.1.454.heavy.3.raw

SEQ ID NO: 464466 - DNA, 517 bp, Homo sapiens
  misc_feature: HEFZJCU01EEEGG.3.71.G05.1.454.heavy.3.raw
agacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggattttccttttggctattttaaaaggtgtccggtgtgaagtgcaactggtggagtctgggggaggcttggtacagcctggcaggtccctgagactctcctgtgcagcctctggattcacctttgatgattatgccatgcactgggtccggcaagctccagggaaggcctggagtgggtctcaggtattacttggaatagtgataacatcggctatgcggactctgtgaagggccgattcaccatctccagagacaacgccaagaactccctgtatctgcaaatgaacagtctgagacctgaggacacggccttgttattactgtgtaaaggtacccgggggtaaatagtagtacgtattttta

SEQ ID NO: 464467 - DNA, 532 bp, Homo sapiens; identical to SEQ ID NO: 445228
  misc_feature: HEFZJCU01CJRKX.7.78.H01.1.454.heavy.3.raw

SEQ ID NO: 464468 - DNA, 478 bp, Homo sapiens
  misc_feature: HEFZJCU01EJ4XM.19.68.G02.1.454.heavy.3.raw
tactctcgtgcacgaccggtgctcgatttagtcgatagtgaagggaaagggggcagagcctgctgaattctggctgaccagggcagtcaccagagctccagacaatgtctgtcgccttcctcatcttcctgcccgtgttgggcctcccatggggtgtcctgtcacaggtgcagctgcaacagtcaggtccaggactggtgaagccctcgcagagcctctcactcacctgtaccatctccggggacagtgtctctagtgacagcgcaacttgggactggctcaggcagtccccatcgagaggccttgagtggctgggaaggacatactacaggtccacgtggtatgatgattatgcagtatctgtgaaaagtcgatttaccatttaagccagacacatccaagaaccagttctccctgcacttgaactctgtgactcccgacgacacggctgtctattactgtgcaagagctcgcaggg

SEQ ID NO: 464469 - DNA, 494 bp, Homo sapiens
  misc_feature: HEFZJCU01AER8E.11.71.G05.1.454.heavy.3.raw
cgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctggggggaggcgtggtccagcctgggaggtccctgagactctcctgtacagcctctggcttcaccttcattacctatggcatgcactgggtccgccagactccaggcagggggctggagtgggtggcagttatttcatatgatggaaattagtgacttctattcagactccgtgaagggccgattcaccgtctccagagacaattccaggcacacgctgtatctgcaatgaacagcctgagagctgaggacacggctgtgtattactgtgcgaaagtatttctat

SEQ ID NO: 464470 - DNA, 513 bp, Homo sapiens
  misc_feature: HEFZJCU01E0NMK.52.36.D03.1.454.heavy.3.raw
cgcagtacgacacgaccggtgctcgatttagctgcgtcacgatctctcttggggtctctgggagaggagctccagccttgggattcccagctgtctccactcggtgatcggcactgaaaacaggagactcagtatggagtttgggctgagctgggttttccttgttgctattttaaaaggtgtccagtgtgagatgcagctggtggagtctggggggaggcttggtccagcctggggggtccctgaaactctcctgtacagcctctgggttccccttcagtggcactgctatgcactgggtccgccaggtttccgggaaagggctggagtgggttggccgcatcagaggcaaggcaaaaagtcacgcgacggcatatgctgcgtcggtgaaaggcaggttcaccatctccagagatgattcagataacacggcgtatctgcaaatgaacaacctgaaaccgaagacacggccgtgtattattgtagtagacattcggggggttctgaagtgcc

SEQ ID NO: 464471 - DNA, 509 bp, Homo sapiens
  misc_feature: HEFZJCU01DBIQ5.4.67.G01.1.454.heavy.3.raw
  modified_base (499)..(499): a, c, t, g, unknown or other
agcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgcgtttctaggtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattaggtggcactggcgattatacatattatacagactccgtgaagggccgcttcaccatctccagagacaattccaagaacacggtgtatctgcaaatgaacagcctgagagccgaggacacggccacatattactgtgacgaaagatctgggctggttccncggtccgggt

SEQ ID NO: 464472 - DNA, 433 bp, Homo sapiens
  misc_feature: HEFZJCU01EIAZZ.51.34.D01.1.454.heavy.3.raw
cgatcgtatacacgaccggtgctcgatttagatcgtctgtgttgggtttggggggaagaggaagactgacggtccccccaggagttcaggtgctggactgggtggcaggcatatcatttgatggaagcaagaagtactatgcagactccgtgaagggccgattcaccatctccagagacagttccgatgacacagtctatctacacatgagcagtgtgagacctgacgacacggctcttttttactgtgcgccaggaagcagtggctggccacatcatgcttttgatatctggagccaagggacaatggtcatcgtctcttcggcctccaccaagggcccatcggtcttccccctggcaccctcctccaagagcacctctgggggcacagcggccctgggctgcctggtcaaggactacttcctcgtagcact

SEQ ID NO: 464473 - DNA, 492 bp, Homo sapiens
  misc_feature: HEFZJCU01BX52I.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaagggctggaatgggtctcatctattagtgctactactggtggcacatacttcgcagactccgtgaagggccggttctccatctccagagacaattccaagaacacgctgtatctgcaattgaacagcctgagagccgaggacacggccgtatattactgtgcgaaagatttggggaatgaccacgtc

SEQ ID NO: 464474 - DNA, 497 bp, Homo sapiens
  misc_feature: HEFZJCU01C3XAT.4.7.A07.1.454.heavy.3.raw
agcactgtagcacgaccggtgctcgatttagcacgtgtcgcaggggctgagagaggagcccagccctgggattttcaggtgtttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccgagggaaggggctggaatgggtctcatctattagtgctactactggtggcacatacttcgcagactccgtgaagggccggttctccatctccagagacaattccaagaacacgctgtatctgcaattgaacagcctgagagcgaggacacggaccgtatattactgtgacgaaagatttaggggaatgaccacgtc

SEQ ID NO: 464475 - DNA, 390 bp, Homo sapiens
  misc_feature: HEFZJCU01C6XPN.13.42.D09.1.454.heavy.3.raw
tcacgtactacacgaccggtgctcgatttagacacatacgcagggaaaggggctggagtggattggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcgcggggcacttttgatatctggggccaagggtcgatggtcatcgtctcttcagcctccaccaagggcccatcggtcttccccctggcgccctgctccaggagcacctccgagagcacagcggccctgggctgcctggtcaaggactacttcctagtacgtga

SEQ ID NO: 464476 - DNA, 506 bp, Homo sapiens
  misc_feature: HEFZJCU01EKEHY.12.79.H02.1.454.heavy.3.raw
atacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgtccactcccaggtgcatctggagcagtctggagctgaggtgaaggagcctggggcctcagtaaaatctcctgcaagtcttctggttacgcactcaccgccaatggtatcagctggctgcgacaggcccctggacaaggtcttgagtggatgtcatggatcagcactttcaatggagacacaaagtatggagagaacttccagggcagagtcaccatgaccactgacagatcaacgaacatagcctacttggaactgaggggcctgaggtctgacgacacggccctctattattgtgcgagaattaattttcgttattgttctggtggtgtgtgttcaatgtttgaccattc

SEQ ID NO: 464477 - DNA, 522 bp, Homo sapiens
  misc_feature: HEFZJCU01CDP03.3.82.H05.1.454.heavy.3.raw
  modified_base (473)..(473): a, c, t, g, unknown or other
  modified_base (513)..(513): a, c, t, g, unknown or other
agacgcactccacgaccggtgctcgatttagtcgagctctctcgcgggggggagaggagcccagcactgggattccgaggtgtttccattcggtgatcagcactgaacacagaggactcaccatggagttttggctgagcgtgggttttcctgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggcccgtttattactgtgcgagagnttcgagtggttcggggacctcacctggtctcttcgatctntgggccgtc

SEQ ID NO: 464478 - DNA, 519 bp, Homo sapiens; identical to SEQ ID NO: 446650
  misc_feature: HEFZJCU01BJC1R.13.76.G10.1.454.heavy.3.raw

SEQ ID NO: 464479 - DNA, 531 bp, Homo sapiens
  misc_feature: HEFZJCU01AM7R3.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagcgtgggttttccgttgttggctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggcccgtttattacctgtgcgagagattcgagtgggttcggggacctcaccctggttctacttcgatctctggggccgtc

SEQ ID NO: 464480 - DNA, 486 bp, Homo sapiens; identical to SEQ ID NO: 448316
  misc_feature: HEFZJCU01AUCY4.3.48.E04.1.454.heavy.3.raw

SEQ ID NO: 464481 - DNA, 531 bp, Homo sapiens; identical to SEQ ID NO: 463628
  misc_feature: HEFZJCU01DR592.12.39.D06.1.454.heavy.3.raw

SEQ ID NO: 464482 - DNA, 528 bp, Homo sapiens
  misc_feature: HEFZJCU01BDJPM.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctgggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttatactgtacgaagagggggatacagtggcagctccaagtactactttgacttctggggccagggaaccctggtcaccgtctcctcagcctccaccaacggcccatcggtccttcccctggccgccctcgcctccaggagcacctccgagacg

SEQ ID NO: 464483 - DNA, 501 bp, Homo sapiens
  misc_feature: HEFZJCU01BBDN5.48.59.F04.1.454.heavy.3.raw
agtatacatacacgaccggtgctcgatttagtacacacacttagggattggggtctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtggaccaagggacaatggtcaccgtctc

SEQ ID NO: 464484 - DNA, 509 bp, Homo sapiens
  misc_feature: HEFZJCU01BFWWT.51.80.H03.1.454.heavy.3.raw
cgatcgtatacacgaccggtgctcgatttagctgtgcgtcgaagggaaaggggaggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagttgctgggaaggacatactacaggtccaagtggtttaatgattatgcagtatctgtgaaaagtcgaataaccatcaacccagacacatccaagaaccagttctccctgcaactgaactctgtgactcccgaggacacggccgtgtattactgtgcaagaggttggttaacagctggaggatttgactactggggccagggaaccctggtcaccgtctcctcagcctccaccaagggcccatcggtcttcccctggccgccctgctccaggagcacctccgagagcacagccggcccgtc

SEQ ID NO: 464485 - DNA, 480 bp, Homo sapiens
  misc_feature: HEFZJCU01CKQCR.11.23.C01.1.454.heavy.3.raw
cgagagataccacgaccggtgctcgatttagtacacgtgattagggattgggggcagggtgtacacctgtggttctcgggactgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgcccagagaagagggatattgctctgatggtgtctgctattacgtctacggtttggacgtctggggccaagggaccacggtcatcgtctcctcagcctccaccaagggcccatcggtctcccctggcaccctcctccagagcacctctggggcacagcggccctggctgcctggtcaaggactacttccgtatctctcg

SEQ ID NO: 464486 - DNA, 494 bp, Homo sapiens
  misc_feature: HEFZJCU01BY135.10.71.G05.1.454.heavy.3.raw
catagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatggggtggcaggatatacaatatgatgacagtaaaatatactatggagactccttcaaggccgattcaccatctccagagacaattccaagaacatggtgtatctgcaaatgaccagcctgagagcgaggacacgggtgttatactgtgggagaatcctagtggctac

SEQ ID NO: 464487 - DNA, 521 bp, Homo sapiens
  misc_feature: HEFZJCU01BGDR2.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattccaccatctccagagacaattccaagaacacgctgtttcttcaaatgaacagcctgagagccgatgacacggccgtgtattactgtgcgagagagtggggcccacgaacgttactacgctatggacgtctggggccgaagggaccg

SEQ ID NO: 464488 - DNA, 498 bp, Homo sapiens
  misc_feature: HEFZJCU01C3RXW.49.57.F02.1.454.heavy.3.raw
agtcgagagacacgaccggtgctcgatttagctcgatatagttgggtttggggacacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttgagtgggtgggaaggatcacccctatccttaatatagcaaactatgcacagacattccacgacagagtcacccttatcgcggacaaatccacgaacacagcctacatggaactgcgcagcctaggatctgccgacacggccgtatatttctgttgcgagagagatgtctttcatgatagtactagtcattatgctt

SEQ ID NO: 464489 - DNA, 497 bp, Homo sapiens
  misc_feature: HEFZJCU01BIWEL.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctgggccaagggacaatggtcaccgtctcttcagcctccaccaagggcccatcggtcttcccctggccaccctcctccaagagcacctc

SEQ ID NO: 464490 - DNA, 511 bp, Homo sapiens
  misc_feature: HEFZJCU01ETCB8.49.6.A06.1.454.heavy.3.raw
agtcgagagacacgaccggtgctcgatttagatctactgacaggggagctctgagagaggagcccagccctgggattttcaggtgttttcatttggtgatcaggactgagcagagagaactcaccatggagtttgggctgagctggctttttcttgtggctattttaaaaggtgtccagtgtgaggtgcagctggtggactctgggggaggcttggtacagcctggggggtccctgagactctcctgtgcagcctctggattcacctttagcagttttgccatgggctgggtccgccaggctccagggaaggggctggagtgggtctcaactattagcggtattggtactaccacatactacgcagactccgtgaagggccgcttcaccatctccagagacaattccaagaacatggtgtttctgcaatgagcagcctgagagccgaggacacggccgtatattactgtgcgaaagttcgcgtgctaggtacatttgactactggggaccg

SEQ ID NO: 464491 - DNA, 506 bp, Homo sapiens
  misc_feature: HEFZJCU01B0VXF.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaagggctggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgcgaaagatctcgggctggttccgcggtccggg

SEQ ID NO: 464492 - DNA, 536 bp, Homo sapiens
  misc_feature: HEFZJCU01CSANA.16.9.A09.1.454.heavy.3.raw
tgtactactccacgaccggtgctcgatttagcgagacgcgcagggggagagaggggcccagccctgggattttcaggtgttttcatttggtgatcaggactgaacagagagaactcaccatggagtttgggctgagctggctttttcttgtggctattttaaaaggtgtccagtgtgaggtgcagttggtggactctgggggagacctgataccgcctggggggtccctgagactctcctgtacagcctctggattcacctttaggagccatgccatgagctgggtccgccaggctccagggaaggggctggagtgggtctctactattactgctagtggtaatcatgcatactatgcagactccgtgaagggccggttcaccttcaccagagacaattccaagaacacgctctatctgcaattgaccagcctgagcgccgaggacacggccatgtattactgtactaaatcgcgggtggccgcggccggtacctcggactgggttttgattttcgtggggtcctaaggggaaccg

SEQ ID NO: 464493 - DNA, 513 bp, Homo sapiens
  misc_feature: HEFZJCU01EWN97.52.78.H01.1.454.heavy.3.raw
cgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttcgtttgggattggttgtcgtttgcacc

SEQ ID NO: 464494 - DNA, 516 bp, Homo sapiens
  misc_feature: HEFZJCU01BC78L.10.59.F04.1.454.heavy.3.raw
catagtagtgcacgaccggtgctcgatttagtacacacacttagggattgggggctttctgagagtcatggacctcctgtgcaagaacatgaatcacctgtggttcttcctcctgctggtggcggcccccagatgggtcctgtcccagctgcagctgcatgagtcgggcccaggactggtgaggccttcggataccctgtccctcagttgcgctgtctctggtggttccatcaacagtggtgacaactggtggggctgggtccgccagcccccagggatgggactggagtggattggccttacacattatagtgggactacccactacaacccgtccctcaggagtcgagtcaccatctcactagacacgtccaggaatcacctctccctgacggtgacctctgtgaccgccgcggacacggccgtgtattattgtgcgagacgaccccggctgaagattcctcaatgtactttgaccactggggccagggagccctgggtcaccgtcttcctcag

SEQ ID NO: 464495 - DNA, 503 bp, Homo sapiens
  misc_feature: HEFZJCU01D11RL.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgacgaaagcaccggcagttagtcacccatactactttgactac

SEQ ID NO: 464496 - DNA, 518 bp, Homo sapiens; identical to SEQ ID NO: 449255
  misc_feature: HEFZJCU01ANX3B.3.17.B06.1.454.heavy.3.raw

SEQ ID NO: 464497 - DNA, 379 bp, Homo sapiens; identical to SEQ ID NO: 444450
  misc_feature: HEFZJCU01DYR04.47.77.G11.1.454.heavy.3.raw

SEQ ID NO: 464498 - DNA, 423 bp, Homo sapiens; identical to SEQ ID NO: 444772
  misc_feature: HEFZJCU01EZL3I.16.78.H01.1.454.heavy.3.raw

SEQ ID NO: 464499 - DNA, 499 bp, Homo sapiens
  misc_feature: HEFZJCU01DXARX.11.71.G05.1.454.heavy.3.raw
  modified_base (461)..(461): a, c, t, g, unknown or other
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgngtattactgtgcgaaagatttctatagaggtgacgtac

SEQ ID NO: 464500 - DNA, 509 bp, Homo sapiens; identical to SEQ ID NO: 447939
  misc_feature: HEFZJCU01BGC7D.17.25.C03.1.454.heavy.3.raw

SEQ ID NO: 464501 - DNA, 489 bp, Homo sapiens; identical to SEQ ID NO: 447707
  misc_feature: HEFZJCU01DJC69.10.55.E11.1.454.heavy.3.raw

SEQ ID NO: 464502 - DNA, 492 bp, Homo sapiens
  misc_feature: HEFZJCU01DKP70.4.28.C06.1.454.heavy.3.raw
  modified_base (448)..(448): a, c, t, g, unknown or other
agcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgaggggccgattcaccatcttcagagacaacgccaaggacacgctgtatctggaaatgagcagtctgagagccgaggacacggctgtgtattactgtgcaagagataacggacttggtacgccctttgactactggggcccggggaccctggtcaccgtctcctcggcctccaccaagggcccatcggtcttcccctggcgccctgctccaggagcacctccgagagcacngcggccctgggctgcctggtcaaggactacttccctacagtgct

SEQ ID NO: 464503 - DNA, 516 bp, Homo sapiens
  misc_feature: HEFZJCU01CSQ1W.9.70.G04.1.454.heavy.3.raw
tgatacgtctcacgaccggtgctcgatttagtgtagtgtgaagggaaagggcctgtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaaactcctactacggtctggacgtctggggccaggggaccaaggtcaccgtctcctcagcctccaccaagggcccatcggtcttccccctggcgccctgctccaggagcacctccgagacgcacagcggccctgggctgcctggtcaaggactacttccagacgtatca

SEQ ID NO: 464504 - DNA, 500 bp, Homo sapiens
  misc_feature: HEFZJCU01EQX9Q.53.80.H03.1.454.heavy.3.raw
cgcgtatacacacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacgacgtccatcagcactgcctacatggagctgaccaggctgaaatttgaggacacggccatttattactgtgcaaggaacagcataatgactcgtcccccggactttacg

SEQ ID NO: 464505 - DNA, 516 bp, Homo sapiens
  misc_feature: HEFZJCU01EJ8LI.51.26.C04.1.454.heavy.3.raw
cgatcgtatacacgaccggtgctcgatttagtctagcgactttgggtttggggtctgggagacgagcccagcactggaagtcgccggtgtttccattcggtgatcatcactgaacacagacatggagtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtat

SEQ ID NO: 464506 - DNA, 502 bp, Homo sapiens
  misc_feature: HEFZJCU01EBB3T.51.71.G05.1.454.heavy.3.raw
cgatcgtatacacgaccggtgctcgatttagtgtcgtcgcaagagagaggggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccggtgaagggccgattgaccatctccagagacaactcgaagaatacggttcttctacaaatgaacagcctgagagctgaggacacggctatgtttactgtgcgagagggaactcgattacagcagccctcgaaacg

SEQ ID NO: 464507 - DNA, 477 bp, Homo sapiens
  misc_feature: HEFZJCU01DXURW.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgaccctggggccagggaaccctggtcaccgtctcctcagcctccaccaagggcccatcggtcttccccctggcaccctcctcccaagagcacctctgggggcacagcggccctgggctgcctggtcaagaactacttccgagtagtaca

SEQ ID NO: 464508 - DNA, 509 bp, Homo sapiens
  misc_feature: HEFZJCU01BKCA6.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaacacagggactgcagtggattggatacatctacttcagtgggaaccccaactacaacccctccctcaggagtccagtcgccatatccctggactcgtccaacaaccagatctccctgacgatgacatctgtgaccgctgcggacacagccgtttattactgtgcgcgatctgggcgactcagtgactatggtatggacgtctgggggccaagggaccacggtcatcgtctcctcagcctccaccaagggcccatcgtctcccctggc

SEQ ID NO: 464509 - DNA, 506 bp, Homo sapiens; identical to SEQ ID NO: 446520
  misc_feature: HEFZJCU01B2EFN.10.38.D05.1.454.heavy.3.raw

SEQ ID NO: 464510 - DNA, 518 bp, Homo sapiens; identical to SEQ ID NO: 448852
  misc_feature: HEFZJCU01DCK22.16.10.A10.1.454.heavy.3.raw

SEQ ID NO: 464511 - DNA, 491 bp, Homo sapiens; identical to SEQ ID NO: 445333
  misc_feature: HEFZJCU01EIJR3.19.53.E09.1.454.heavy.3.raw

SEQ ID NO: 464512 - DNA, 513 bp, Homo sapiens
  misc_feature: HEFZJCU01DZTSA.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggccgccctgctccaggacgcacctccgagagcacagcggccctggg

SEQ ID NO: 464513 - DNA, 470 bp, Homo sapiens; identical to SEQ ID NO: 445307
  misc_feature: HEFZJCU01DFKIA.12.78.H01.1.454.heavy.3.raw

SEQ ID NO: 464514 - DNA, 500 bp, Homo sapiens; identical to SEQ ID NO: 445720
  misc_feature: HEFZJCU01A8MHC.3.20.B09.1.454.heavy.3.raw

SEQ ID NO: 464515 - DNA, 522 bp, Homo sapiens
  misc_feature: HEFZJCU01CW5HY.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtctttcggaacagggtcaccctgacctgggacgcgtcccgcaatacagcctccatggaattgaccacactgaaatctgacgacacggccgtctactattgtgcgagggtcaatagtcttaccataaacggtgcccgggacagatgatttttggatgtctggggccaaggtacagcggtcaccgtcgcctcagcctccaccaagggcccatccggtcttccccctggcaccctcctccaagagcacctctgggggtcacac

SEQ ID NO: 464516 - DNA, 495 bp, Homo sapiens
  misc_feature: HEFZJCU01CJLAN.4.21.B10.1.454.heavy.3.raw
agcactgtagcacgaccggtgctcgatttagtgtcgtcgcaagagagggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaagggcccatcggtcttcccctggcgccctgctccaggagcacctcgagagcacagcggccctgggctggcctggtacaggactacttccctacagtgct

SEQ ID NO: 464517 - DNA, 395 bp, Homo sapiens; identical to SEQ ID NO: 444517
  misc_feature: HEFZJCU01BXPCH.16.68.G02.1.454.heavy.3.raw

SEQ ID NO: 464518 - DNA, 506 bp, Homo sapiens; identical to SEQ ID NO: 449588
  misc_feature: HEFZJCU01AMWGA.11.72.G06.1.454.heavy.3.raw

SEQ ID NO: 464519 - DNA, 506 bp, Homo sapiens; identical to SEQ ID NO: 448877
  misc_feature: HEFZJCU01CELWK.13.37.D04.1.454.heavy.3.raw

SEQ ID NO: 464520 - DNA, 479 bp, Homo sapiens
  misc_feature: HEFZJCU01AUQ1I.40.83.H06.1.454.heavy.3.raw
tctagcgactcacgaccggtgctcgatttagatcacgtgcgtcgcgggggggagaggagcccagcactcgaagtcggcggtgttgccattcggtgatcagcactgaacacagaggactcaccatggagtttgggctgagctgggttttcctcgttgctcttttaagaggtgtccagtgtcaggtgcagttggtggagtctgggggaggcgtggtccagcctgggaggtcactgagactctcctgtgcatcgtccggattcaccttccataaatataacatgcactgggtccgccaggctccaggcaagggactgcagtggctggccactgtctggtcggatgaaagttatgcatactatgcagactctctgaggggccgattcatcatctctagagacaattcgaagaacacggcttatctgcaaatgaacagcctgacagtcgaggacacggctgtatatttctgtgcgaatgaggaa

SEQ ID NO: 464521 - DNA, 507 bp, Homo sapiens; identical to SEQ ID NO: 446095
  misc_feature: HEFZJCU01DY85P.10.38.D05.1.454.heavy.3.raw

SEQ ID NO: 464522 - DNA, 541 bp, Homo sapiens
  misc_feature: HEFZJCU01DE2YX.52.54.E10.1.454.heavy.3.raw
cgcagtacgacacgaccggtgctcgatttagatcgtagcagaacacacaaaggggacccaaaaaccacacccctccttgggagaatcccctagatcacagctcctcaccatggcctggacctggagcatccttttcttggtggcagcagcaacaggtgcccactcccaggttcacctggtgcagtcgggaggtgaggttaagaggcctggggcctcagtgaaggtcgcctgcaaggcttcaggttacaccctttccacgtctggtatcagttgggtgcgacaggcccccggacaaggggcttgagtggatgggatggatcagcggtgacaacggcaacacaaattatggacagaagttccagggcagagtcaccatgaccgcggacacatccacgaacacagcctacatggagctgaggagcctaagatctgacgacacggccgtttattactgtgtgagagattttagggacctcggcccttggggggagttagtcggttactttgactactggggccagggaacccaggtcaccggtct

SEQ ID NO: 464523 - DNA, 516 bp, Homo sapiens
  misc_feature: HEFZJCU01BO271.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccagcgggagttccaagtactcc

SEQ ID NO: 464524 - DNA, 478 bp, Homo sapiens
  misc_feature: HEFZJCU01DET2A.26.78.H01.1.454.heavy.3.raw
agactatactcacgaccggtgctcgatttagtgtgagtagtttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcctctggattcaccttcagttacctatactatgcactgggtccgccaggctccaggcaaggggctggagtgggtggcagttatatcatatgatggaagcagcacatattacacagactccgtgaagggccgattcaccatctccagagacaatttgaagaacacgctgtatctgcaaatgaacagcctgagagctgaagacacggctgtgttttactgtgcgagagaga

SEQ ID NO: 464525 - DNA, 517 bp, Homo sapiens
  misc_feature: HEFZJCU01A4A8G.52.52.E08.1.454.heavy.3.raw
  modified_base (496)..(496): a, c, t, g, unknown or other
cgcagtacgacacgaccggtgctcgatttagtcgagctctcagagagaaaggggatactttctgagactcatggacctcctgcacaagaacatgagacacctgtggttcttcctcctcctggtggcagctcccagatgggtcctgtctcaggtgcagctgcaggagtcgggcccaggactggtgaagccttcggggaccctgtctctcacctgcgctgtctctggtgggtccatcagaagtagtaactggtggagttgggtccgccagcccccagggaagggtctggagtggattggggaaatctatcatactgggaacaccaactacagcccgtccctcaagagtcgagtcgccatatcactagaccaggcgaacaacgagttctccctgaaactgagctctgtgaccgccgcagacacggccgtgtattattgtgggagagatcggagagatagtagtggtttttactacggtgactacgacggtatggacgtntggggccaagggaccacggtc

SEQ ID NO: 464526 - DNA, 397 bp, Homo sapiens
  misc_feature: HEFZJCU01D1NA6.4.79.H02.1.454.heavy.3.raw
agcactgtagcacgaccggtgctcgatttagtgtcacacgaagggaaggggctggagtggctttcatacattgatagtagtgggaagatcatatactacgcagactctgtgaagggccgattcaccgtctccagagacaacgccaacaactcactgtttctgcaaatggacagcctgagagccgaggactcggctgtttattactgtgcgagagattccaggagtttgatgctagcgagggcctactatgactactggggccagggaaccaaggtcaccgtctcctcagcctccaccaagggcccatcggtcttccccctggcgccctgctccaggagcacctccgagagcacagcggccctgggctgcctggtcaaggactattccctacagtgct

SEQ ID NO: 464527 - DNA, 469 bp, Homo sapiens
  misc_feature: HEFZJCU01B57AG.16.78.H01.1.454.heavy.3.raw
tgtactactccacgaccggtgctcgatttagtgtgagtagtttgggtttgggctcaactctcctgtgcagcctctggattcaccttgagaacttatagcatgaactgggtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcgggggactacctcgacccctggggccagggaatactggtcaccgtctcctcagcctccaccaagggcccatcggtcttccccctggcaccctcctccaagagcacctctgggggcacagcggccctgggctgccctggtcaagggactacttccgagtagtaca

SEQ ID NO: 464528 - DNA, 498 bp, Homo sapiens
  misc_feature: HEFZJCU01CD5Y9.51.78.H01.1.454.heavy.3.raw
  modified_base (67)..(67): a, c, t, g, unknown or other
cgatcgtatacacgaccggtgctcgatttagtgtgagtagtttgggtttgggggaggcctggtacancctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttcccctggcaccctcctccaagagcacctctgggggacacagcggccctgggctgcctggtcaaggactacttcctcgtagcact

SEQ ID NO: 464529 - DNA, 507 bp, Homo sapiens; identical to SEQ ID NO: 444486
  misc_feature: HEFZJCU01CXOEI.4.67.G01.1.454.heavy.3.raw

SEQ ID NO: 464530 - DNA, 518 bp, Homo sapiens
  misc_feature: HEFZJCU01D0GIE.12.40.D07.1.454.heavy.3.raw
  modified_base (504)..(504): a, c, t, g, unknown or other
  modified_base (515)..(515): a, c, t, g, unknown or other
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaaggcccancggtctccccngcg

SEQ ID NO: 464531 - DNA, 501 bp, Homo sapiens
  misc_feature: HEFZJCU01DFQA2.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataacagtctgagacttgaggacacggctgtctattactgtgcgagagactacggtgaccttttctggtatttcgatctctggggccgtggcaccctggtcactgtctcctcggcttccaccaagggcccatcggtcttcccctggcgccctgctccaggagcacctctggggc

SEQ ID NO: 464532 - DNA, 509 bp, Homo sapiens
  misc_feature: HEFZJCU01C53XB.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgtgagagagtggggcccacgtaacgttactacgctatggacgtcgt

SEQ ID NO: 464533 - DNA, 518 bp, Homo sapiens; identical to SEQ ID NO: 449255
  misc_feature: HEFZJCU01CJX6F.3.17.B06.1.454.heavy.3.raw

SEQ ID NO: 464534 - DNA, 510 bp, Homo sapiens; identical to SEQ ID NO: 451092
  misc_feature: HEFZJCU01A3VTN.18.39.D06.1.454.heavy.3.raw

SEQ ID NO: 464535 - DNA, 516 bp, Homo sapiens
  misc_feature: HEFZJCU01BC6OW.14.14.B03.1.454.heavy.3.raw
cgtctagtaccacgaccggtgctcgatttagtgtgagtagtttgggctgagctgggtcttccttgttgctattataaaaggtgtccagtgtcaagtgcagttggtggagtctgggggaggcttggtcaagcctggagggtccctgagactctcctgtgcagcctctggattcaccttcagtgactactacatgacctggatccgccaggcgccagggaagggctggaatggattgcatacattcactatagtggaaatgcagtgtcctacgcagactctctgaagggccgattcaccgtctccagggacaacgccaagaactcgctgtatctgcaaatcgacggcctgagagtcgaggacacggccatgtattactgtgcgagagtgtggttcggtcatgttttagaagttggggcttttgaccactggggccagggaaccctggtcaccgtctcttcagcctccaccaaggcccatcggtcttcccctgccaccctcctccaagagcacctcgtc

SEQ ID NO: 464536 - DNA, 509 bp, Homo sapiens
  misc_feature: HEFZJCU01BAU0E.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacggcacggccgtctattactgtgcgagagtcccacgatccggtgagcctacggcagcggcctttgacttctggggccaggggacg

SEQ ID NO: 464537 - DNA, 543 bp, Homo sapiens
  misc_feature: HEFZJCU01AXQV3.49.31.C09.1.454.heavy.3.raw
agtcgagagacacgaccggtgctcgatttagacgtctcatcaaggaaggaagggggagagaggagcccagccctgggattttcaggtgttttcatttggtgatcaggactgaacagagagaactcaccatggagtttgggctgagctggctttttcttgtggctttttaaaaggtgtccagtgtgaggtggagctgttggagtctgggggaggcttggtacaatttggggggtccctgggactctcctgtgcagcctctggattcactttcagcagctatggcatgaactgggtccgccaggctccagaaaaggggctggagtgggtctcaggtattagtggtagtggtggtatcacatcctacgtagactccgtgaagggccggttcaccatctccagagacaattccaagaacaaactttatttgcacatggaaagcctgagagcccgaggacacggccatatattactgtgcgagacgtgggaaactacttaagggaggtgcttttgtatgtctggggcctaaggggacaagtgggtccg

SEQ ID NO: 464538 - DNA, 464 bp, Homo sapiens; identical to SEQ ID NO: 445533
  misc_feature: HEFZJCU01CD53H.19.10.A10.1.454.heavy.3.raw

SEQ ID NO: 464539 - DNA, 510 bp, Homo sapiens
  misc_feature: HEFZJCU01AJF2G.48.81.H04.1.454.heavy.3.raw
agtatacatacacgaccggtgctcgatttagtagtgtagattcgcgggggcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccaggggcagaatcacacttaccgcggacaaatccacgggcacagcgcagttggacctgagcggcctgagacgtgagacacggccattactactgtgcgcggggaggtggacggagcgtcggttttcggagttatcatctactactttgtaac

SEQ ID NO: 464540 - DNA, 505 bp, Homo sapiens
  misc_feature: HEFZJCU01CEIFF.52.2.A02.1.454.heavy.3.raw
  modified_base (437)..(437): a, c, t, g, unknown or other
cgcagtacgacacgaccggtgctcgatttagactcatctacagggggggagaggagcccagcactagaagtcggcggtgtttccattcggtgatcagcactgaacacagaggactcaccatggagtttgggctgagctgggttttcctcgttgctctttaagaggtgtccagtgtcaggtgcaggtggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcatatgatggaagtaaaatatactatgtagactccgtgaagggccgattcatcatctccagagacaattccgagaacaccctgtatctgcaaatgaacagcctgaagngctgaggacacggctgtgtattacgtgtgcgaactttaatcacgggagacaacggtcggcccccgtcc

SEQ ID NO: 464541 - DNA, 498 bp, Homo sapiens
  misc_feature: HEFZJCU01C5CY7.51.43.D10.1.454.heavy.3.raw
cgatcgtatacacgaccggtgctcgatttagactagcagtaagggggagcatcacccagcaaccacatctgtcctctagagaatcccctgagagctccgttcctcaccatggactggacctggaggatcctcttcttggtggcagcagccacaggagcccactcccaggtgcagctggtgcagtccgggggtgaagtgaagaagcctggggcctcagtgaaggtctcctgcagggcctctggatacaccttcaccggctattatatccactgggtgcgacaggcccctggacaagggcttgagtggatgggatggatgaagcccaatagtggtgcacaagacagcacagaagtttcagggcagggtcaccatgaccagggagacgtccgtcaggacagcctatatggaggtgaccagcctgagccctgacgacacggccatatattttctgtgcgcgaggaatttcgacttctggaatattactggttggaactactt

SEQ ID NO: 464542 - DNA, 516 bp, Homo sapiens
  misc_feature: HEFZJCU01BVBA8.14.5.A05.1.454.heavy.3.raw
cgtctagtaccacgaccggtgctcgatttagatagatagacagggggccccagccctgggattcccagctgtttctgcttgctgatcaggactgcacacagagaactcaccatggagtttgggctgagctgggttttccttcttgctattttaaaaggtgtccaatgtgaggtgcagctggtggagtccgggggaggcttagttcagccgggggggtccctgagactctcctgtgaaacctctggattcagcttcagtagttactggatgcactgggtccgccaagttccagcgaaggggctggtgtgggtcgcacgcattgatagtgatggcagaagcgcaagctagtggggactccgtgaagggccgattcaccatctccagagacaacgcaagaacacgctgttcctgacaaatgaacagtctgagagccgacgacacggctgtatattactgtagtaagagtattccgtctatggagatggctactaattaccaaactgggttacgactacc

SEQ ID NO: 464543 - DNA, 509 bp, Homo sapiens
  misc_feature: HEFZJCU01D8JK2.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcgccgtctcctcagcctccaccaagggcccatcggtcttcccctggcaccctcctccagagcacctctgggggcacagcggccctgggctgcctggtcaaggactacttcctacgtccgtat

SEQ ID NO: 464544 - DNA, 494 bp, Homo sapiens
  misc_feature: HEFZJCU01COWP8.16.37.D04.1.454.heavy.3.raw
tgtactactccacgaccggtgctcgatttagtagcatactgtgggtttggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccaagagcacctctgggggcacagcggccctgggctgcctggtcaggactacttccgagtagtaca

SEQ ID NO: 464545 - DNA, 492 bp, Homo sapiens
  misc_feature: HEFZJCU01ARDJ5.49.82.H05.1.454.heavy.3.raw
agtcgagagacacgaccggtgctcgatttagtcgagctctctcgcgggtctcagagaggtgccttagccctggattccaaggcatttccacttggtgatcagcactgaacacagaggactcaccatggaattggggctgtgctgggttttccttgttgctattttagaaggtgtccactgtgacgtgcagctggtggagtctgggggagccttggttcagcctggagggtccctgagactctcctgtgcagcctctggtattcagcttcagtagttatgagatgaactgggtccgccaggctccagggaagggactggagtgggtttcatacattagtcggagagtcaacaccgtattctacacagactctgtcaggggccgattcaccatctccagagacaacgccaagaactcactgtatctccaaatgaacagcctgagagtcgaggacacggctgtctattactgtgcgagagatcccaacagcggct

SEQ ID NO: 464546 - DNA, 506 bp, Homo sapiens
  misc_feature: HEFZJCU01A6PD0.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggagggggaacgagcgggagttccaagtactccttgacgtc

SEQ ID NO: 464547 - DNA, 517 bp, Homo sapiens
  misc_feature: HEFZJCU01B0QO0.13.76.G10.1.454.heavy.3.raw
tcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccaagggacc

SEQ ID NO: 464548 - DNA, 539 bp, Homo sapiens; identical to SEQ ID NO: 447062
  misc_feature: HEFZJCU01EDNQE.16.39.D06.1.454.heavy.3.raw

SEQ ID NO: 464549 - DNA, 408 bp, Homo sapiens
  misc_feature: HEFZJCU01A8P5P.52.27.C05.1.454.heavy.3.raw
cgcagtacgacacgaccggtgctcgatttagacgcgatcgaagggtttgggtccggcagccccccgggaagggcctggagtggattggagatatctactacagcgggggcaccagctacagtccctccctcaagagtcgagttggcatatcaatagacacgtccaagaatcagttctccctgaagctgaaatctatcattgttgcggacacggccgtctattattgtgcgagacatggcagcccatatagtcgctggttcgaccctgggcccgggaatcccggtcaccgtctccccagcttccaccaagggcccatcggtcttccccctggcgccctgctccaggagcacctctgggggcacagcggccctgggctgcctggtcaaggactacttcctattacgatcg

SEQ ID NO: 464550 - DNA, 502 bp, Homo sapiens
  misc_feature: HEFZJCU01CPTQK.15.55.E11.1.454.heavy.3.raw
tctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtgttagtggtgaaaacacatattacgcaggctccgtgaagggccgcttcaccatctccagagacaattccaacaacacactttatcttcaaatgaacagcctgcgagccgaggacacggccgtatactactgtgcgagagatcgaacaggcccgtgggagcccgttgactactggggccagggaaccctggtcaccgtctcctcaacctccaccaagggcccatcggtcttcccctggcaccctcctccaagagcacctctgggggcacagcggccctgggctgcctggtcaaggactactccgctacgtaga

SEQ ID NO: 464551 - DNA, 493 bp, Homo sapiens
  misc_feature: HEFZJCU01AQB7F.52.86.H09.1.454.heavy.3.raw
cgcagtacgacacgaccggtgctcgatttagtgctatagacttgggtttgggggaggcttggtccagcctggtggttccctgagactctcctgtgcagcctctggatttccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttctggggccagggaacccgggtcaccgtctcctcagcctccaccaagggcccatcggtcttcccctggcaccctcctccaagagcacctctgggggcacagcggccctgggctgcctggtcaaggactacttcctatacgatcg

SEQ ID NO: 464552 - DNA, 518 bp, Homo sapiens; identical to SEQ ID NO: 451152
  misc_feature: HEFZJCU01DDS2T.13.76.G10.1.454.heavy.3.raw

SEQ ID NO: 464553 - DNA, 396 bp, Homo sapiens; identical to SEQ ID NO: 444426
  misc_feature: HEFZJCU01B9CZ4.18.31.C09.1.454.heavy.3.raw

SEQ ID NO: 464554 - DNA, 516 bp, Homo sapiens
  misc_feature: HEFZJCU01CZYZL.49.25.C03.1.454.heavy.3.raw
agtcgagagacacgaccggtgctcgatttagtagtgtagatttgggtttggggctgggagaggagcccagcactgggattccgaggtgtttccattcagtgatctgcactgaacacagaggactcgccatggagtttgggctgagctgggttttccttgttgctattttaaaaggtgtccagtgtgacgtgcaggtggtggagtctgggggaggcttggtccagcctggggggtccctgacactctcctgtatagtctctggattcaccgtcagtaacaactacatgagttgggtccgccaggctccagggaagggactggagtgggtctcagttatttatagcggtggtgacacatactacgcagactccgtgaagggcagattcaccatctccagagacggtttcaagaacacactctatcttcaaatgaacagcctgagagccgaggacacggctgtgtattactgtgcgagagatccccgggtatagcagtgtctggtacatattactgggg

SEQ ID NO: 464555 - DNA, 486 bp, Homo sapiens; identical to SEQ ID NO: 445770
  misc_feature: HEFZJCU01CNM0L.3.75.G09.1.454.heavy.3.raw

SEQ ID NO: 464556 - DNA, 498 bp, Homo sapiens
  misc_feature: HEFZJCU01AOFC7.48.59.F04.1.454.heavy.3.raw
agtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctgggagtggattgggagtatttaccacagtgggagcacctactacaacccgtccctcaaaagtcgaggcaccatatccgtagacacgtccaagaaccaattctcctgaagctgagctctgtgaccgccgcagacacggctgtctattactgtgcgaggcccgagcgcagtggcttttgatgcttgatatgtgggcgaagggacaatgtcaccgt

SEQ ID NO: 464557 - DNA, 517 bp, Homo sapiens
  misc_feature: HEFZJCU01ESKG8.40.9.A09.1.454.heavy.3.raw
tctagcgactcacgaccggtgctcgatttagcgagacgcgcaggggggtctcagagaggagccttagccctggactccaaggcctttccacttggtgatcagcactgagcacagaggactcaccatggaattggggctgagctgggttttccttgttgctattttagaaggtgtccagtgtgcggtgaaactagcggagtctgggggaggcttggtccagcctggggggtccctaagactctcctgcgcagcctctggattcatgtttagtgattattggatggcttgggtccgtcaggctccagggaaagggctggagtttgtggccaagatgaaccacgacggaaatgagaaaaactatgcggactctgtgaagggccgattcaccatttccagagacaacgccaagaagtcactctctctacacatgaccagcctgacagccgaggacacggctgtttattactgtgcgagagatggcactcggggcggtgactttgactactggggccagggg

SEQ ID NO: 464558 - DNA, 512 bp, Homo sapiens
  misc_feature: HEFZJCU01B7EPS.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccattcatcatctccagagacaacgccgacaactcactgtctctgctgatgagcagcctgagagccgacgacacggctatctattactgtgcgaaactctcattccgttcatctgaatacgtggggccaggggaaccctggtcgtccg

SEQ ID NO: 464559 - DNA, 496 bp, Homo sapiens; identical to SEQ ID NO: 446592
  misc_feature: HEFZJCU01C2QLD.4.75.G09.1.454.heavy.3.raw

SEQ ID NO: 464560 - DNA, 501 bp, Homo sapiens; identical to SEQ ID NO: 447123
  misc_feature: HEFZJCU01B3CP3.3.20.B09.1.454.heavy.3.raw

SEQ ID NO: 464561 - DNA, 513 bp, Homo sapiens; identical to SEQ ID NO: 446699
  misc_feature: HEFZJCU01EOVQU.12.25.C03.1.454.heavy.3.raw

SEQ ID NO: 464562 - DNA, 520 bp, Homo sapiens
  misc_feature: HEFZJCU01DI32I.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtgtcattagacctaggatacaacgacggtggtacctggtattcg

SEQ ID NO: 464563 - DNA, 484 bp, Homo sapiens
  misc_feature: HEFZJCU01EUAB3.47.59.F04.1.454.heavy.3.raw
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggcccatcggtcttccccctggcgccctgctccaggagcacctccgagagcacagcggccctggggctgcctggtcaaggactacttcctacgtgagct

SEQ ID NO: 464564 - DNA, 513 bp, Homo sapiens
  misc_feature: HEFZJCU01CXNFH.12.1.A01.1.454.heavy.3.raw
atacgacgtacacgaccggtgctcgatttagacgtctcatcagggggggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagtagtagttattactactggggctggatccgccagcccccaggggaggggctgaagtggattgggagtgtctattatagtgggatcacctactacaacccgtcctcaagagtcgagtcaccatatccgtcgacacgtccaagaaccagttctccctgaagctgagctctgtgaccgccgcagacacggctgtgtattactgtgcgagacagccaagacagattttggagtggttactgttggactactttgactacgtggggccaggggaaccctggtcc

SEQ ID NO: 464565 - DNA, 495 bp, Homo sapiens; identical to SEQ ID NO: 450151
  misc_feature: HEFZJCU01C7LDA.51.30.C08.1.454.heavy.3.raw

SEQ ID NO: 464566 - DNA, 509 bp, Homo sapiens
  misc_feature: HEFZJCU01CYMFD.19.15.B04.1.454.heavy.3.raw
  modified_base (300)..(300): a, c, t, g, unknown or other
  modified_base (356)..(356): a, c, t, g, unknown or other
  modified_base (460)..(460): a, c, t, g, unknown or other
tactctcgtgcacgaccggtgctcgatttagacagtatatatccgcggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctctgcattcaccttcagtgaccacaacatggactgggtccnccaggctccagggaagggctggagtgggtcggccgtattacaaggaaagctaaacngttacagtacagaatacggcgcgtctgtgaaaggaaggttcaccatctcaagagatgattcaaagaactcactgtatctgcaaatgaacagcctagaaaaccgnggacacggccgtgtattatgtggtagacaaagagtggatgtggtggtag

SEQ ID NO: 464567 - DNA, 519 bp, Homo sapiens
  misc_feature: HEFZJCU01DRXBZ.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaagggctggagtgggtttcatacatttatcctagtggtgataccatatactacgcagactctgtgaagggccgattcaccatctccagggacaacgccaagaactcactgacttgcaaatgaacaccctgcgagccgaggacacggccgtatattactgtgcgagaataacccgttcgcctggttattaccg

SEQ ID NO: 464568 - DNA, 510 bp, Homo sapiens
  misc_feature: HEFZJCU01ESVMT.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaggcagattcatcatctcaagagatgattccaacggcatcgcctatctgcagatgaacagcctagaagaccgaggacacagccgtctattactgtgttagggtagtttacgtattttggta

SEQ ID NO: 464569 - DNA, 521 bp, Homo sapiens
  misc_feature: HEFZJCU01DQKG2.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacgaacgttactacgctatggacgtcgtggggccaagggaccc

SEQ ID NO: 464570 - DNA, 523 bp, Homo sapiens
  misc_feature: HEFZJCU01BB1VF.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtcgtctggtggtcccatcagaggtggtggcttctactggagctggatccgccagcaccccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccactaggtttgactactgggggccaggggaagcttggtcaccgtctctcagcct

SEQ ID NO: 464571 - DNA, 490 bp, Homo sapiens
  misc_feature: HEFZJCU01BA7UJ.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaagggctggaatgggtctcatctattagtgctactactggtggcacatacttcgcagactccgtgaagggccggttctccatctccagagacaattccaagaacacgctgtatctgcaattgaacagcctgagagccgaggacacggccgtatattactgtgcgaaagatttggggaatgaccact

SEQ ID NO: 464572 - DNA, 497 bp, Homo sapiens
  misc_feature: HEFZJCU01BIMT1.51.78.H01.1.454.heavy.3.raw
cgatcgtatacacgaccggtgctcgatttagtgtgagtagtttgggtttgggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttcccctcggccaccctcctccaagagcacctctgggggcacagcggccctgggctgcctggtcaaggactacttcctcgtagcact

SEQ ID NO: 464573 - DNA, 512 bp, Homo sapiens; identical to SEQ ID NO: 447906
  misc_feature: HEFZJCU01CW1RB.17.33.C11.1.454.heavy.3.raw

SEQ ID NO: 464574 - DNA, 506 bp, Homo sapiens; identical to SEQ ID NO: 446520
  misc_feature: HEFZJCU01EVIRC.10.38.D05.1.454.heavy.3.raw

SEQ ID NO: 464575 - DNA, 500 bp, Homo sapiens; identical to SEQ ID NO: 445720
  misc_feature: HEFZJCU01DZ36U.3.20.B09.1.454.heavy.3.raw

SEQ ID NO: 464576 - DNA, 481 bp, Homo sapiens
  misc_feature: HEFZJCU01D3CAA.26.78.H01.1.454.heavy.3.raw
agactatactcacgaccggtgctcgatttagtgtgagtagtttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagttactatactatgcactgggtccgccaggctccaggcaaggggctggagtgggtggcagttatatcatatgatgggaagcagcacatattacacagactccgtgaagggccgattccaccatctccagagacaatttgaagaacacgctgtatctgcaaatgaacagcctgagagctgaaagacacggctgtgttttactgtgcgagagaga

SEQ ID NO: 464577 - DNA, 509 bp, Homo sapiens
  misc_feature: HEFZJCU01BQFSA.10.12.B01.1.454.heavy.3.raw
catagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatctgggggaggcgtggtccagccaggggaggtccctgagactctcctgtgcagcctctggattgaggttcaataactatgctatgcactgggtccgccaggctccagggaaggggctggaatggatgacagttatttcacacgatgcaaccaaaacatactacgcggagttcgtgaggggccgctgcatcgtctccagagacaattcgaagaacactctgtacctgcaaatgaacagtctgagagccgaggacacggccgtctacttttgtgcgactagaagtgggagctagtaggggatttgatttcc

SEQ ID NO: 464578 - DNA, 520 bp, Homo sapiens
  misc_feature: HEFZJCU01CU0SX.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttataccttgacacttggggccagggaaccctggtcacgtctcctcagcctccaccaagggcccatcggtcttcccctggcgccctgctccagagcacctccgagagcacagcgccctgggctgcctggtcaaggactactcca

SEQ ID NO: 464579 - DNA, 391 bp, Homo sapiens; identical to SEQ ID NO: 444994
  misc_feature: HEFZJCU01DNMDS.40.58.F03.1.454.heavy.3.raw

SEQ ID NO: 464580 - DNA, 513 bp, Homo sapiens
  misc_feature: HEFZJCU01DWBI1.4.57.F02.1.454.heavy.3.raw
agcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgcctgctccaggagcacctctgggggcacagcc

SEQ ID NO: 464581 - DNA, 379 bp, Homo sapiens; identical to SEQ ID NO: 445912
  misc_feature: HEFZJCU01AWMH6.47.77.G11.1.454.heavy.3.raw

SEQ ID NO: 464582 - DNA, 524 bp, Homo sapiens
  misc_feature: HEFZJCU01BDAX2.12.71.G05.1.454.heavy.3.raw
atacgacgtacacgaccggtgctcgatttagtgtcgtcgcaagagagaggggaagacggatgggcccttggtggaggcgtgaggtgaaggagcctgggtccgtcggtgaaggtctcctgcaaggcttctggagacaccttcaatagatattctgtcaattgggtgcgacaggccctggacaaggatttgagtggatgggagggatcactcctgtcttcagaacctcaaaatacgcaccagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccaggtcaccgtctcctcagcctccaccaagggcccatccgtcttccccctggcgccctgctcccaggagcacctccgagagcaacagcggccctgggctgcctggtcaaggactactcctcg

SEQ ID NO: 464583 - DNA, 501 bp, Homo sapiens
  misc_feature: HEFZJCU01DYIK5.53.83.H06.1.454.heavy.3.raw
  modified_base (495)..(495): a, c, t, g, unknown or other
cgcgtatacacacgaccggtgctcgatttagatcacgtgcgtcgcggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcggggggacgcgtggtccagcctgggaggtccctgagactctcctgtgtagcctctggatttaccttcagggtctatgacatgcactgggtccgccaggctccaggcaaggggctggagtgggtggcacttatctcacatgatggaaataaaaaactatggtgactccgtgaagggccgattctccgtctccagagacaattccaagaacaccttgtatctgcaaatgaacagcctgagatatgaggacacggctctgtattactgtgcgaaagaaaggttactgtggaagagnggagtt

SEQ ID NO: 464584 - DNA, 531 bp, Homo sapiens; identical to SEQ ID NO: 456474
  misc_feature: HEFZJCU01EYO7Q.18.59.F04.1.454.heavy.3.raw

SEQ ID NO: 464585 - DNA, 423 bp, Homo sapiens; identical to SEQ ID NO: 446550
  misc_feature: HEFZJCU01DT9WH.11.22.B11.1.454.heavy.3.raw

SEQ ID NO: 464586 - DNA, 510 bp, Homo sapiens
  misc_feature: HEFZJCU01CEN3S.51.40.D07.1.454.heavy.3.raw
cgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtctgggggagcgtggtccagcctgggaggtccctgagactctcctgtgtagtctctggattcaccttcagggtgtacgacatgcactgggtccgccaggctccaggcaagggggctggagtgggtggcatttatatcacatgatggaagtaaaacatactatgcagagtccgtgaagggccgattcaccatctccagagacaattccaagaacacactgtttctgcacattgaaaagcctgagagctgaggacacggctgtttatactgtgcgaacttatcacggaggacaacggtaaccccgg

SEQ ID NO: 464587 - DNA, 491 bp, Homo sapiens
  misc_feature: HEFZJCU01BVWCB.19.53.E09.1.454.heavy.3.raw
  modified_base (486)..(486): a, c, t, g, unknown or other
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgacgagcacagcggccctgggctgcctggtcaaggactactcccacgngagta

SEQ ID NO: 464588 - DNA, 495 bp, Homo sapiens; identical to SEQ ID NO: 446450
  misc_feature: HEFZJCU01BEVZA.16.37.D04.1.454.heavy.3.raw

SEQ ID NO: 464589 - DNA, 519 bp, Homo sapiens
  misc_feature: HEFZJCU01A1LZX.13.76.G10.1.454.heavy.3.raw
  modified_base (459)..(459): a, c, t, g, unknown or other
tcacgtactacacgaccggtgctcgatttagtcactcatacagggggggagaggagcccagcactgggattccgaggtgtttccattcggtgatcagcactgaacacagaggactaaccatggagttttggctgagcgtggtttcgttgttaggctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttattatagtagtggtagtacatactccgcagactccgtgaggggccgattcaccatctccagagacaattccaagaacacgctgtttcttcaaatgaacagcctgagagccgatgacacggccgtgtattacngtgcgagagatggggccacgaacgttactacgctatggacgtctggggccaagggaccac

SEQ ID NO: 464590 - DNA, 379 bp, Homo sapiens; identical to SEQ ID NO: 444450
  misc_feature: HEFZJCU01A7SAO.47.77.G11.1.454.heavy.3.raw

SEQ ID NO: 464591 - DNA, 541 bp, Homo sapiens
  misc_feature: HEFZJCU01AJIW3.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacggggcggtttgtcttctccatggatacctctgtcgggacggcttatctgcagataaccaaccttcaacctgacgacactgccgtttattttgtacgtagagcgtcgtctgtcagtggaattgactactggggccaggggaaccctggtcaccgtctcctcacgcctccaccaacgggcccacg

SEQ ID NO: 464592 - DNA, 504 bp, Homo sapiens
  misc_feature: HEFZJCU01DXZRM.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctgggccagggagcccaggtcaccgtctccccagcctccaccaaggcccatcggtcttcccctggccgccctcgctccacgagcacctccgagagcacagcgcctgggctgcctggtcaaggactacttccactactacg

SEQ ID NO: 464593 - DNA, 497 bp, Homo sapiens
  misc_feature: HEFZJCU01DSC7R.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaaccaggtggtccttacaatgaccaacatggaccctgtggacacagccacataattactgtgcacagagatacgggcagcacgtggtttggggctactggggccagggaaccctggtcaccgtctcctcagcctccaccg

SEQ ID NO: 464594 - DNA, 510 bp, Homo sapiens
  misc_feature: HEFZJCU01B35X9.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctcattccgtcatctgaatactggggccagggaaccctggtcgtccg

SEQ ID NO: 464595 - DNA, 489 bp, Homo sapiens
  misc_feature: HEFZJCU01BJV66.48.25.C03.1.454.heavy.3.raw
agtatacatacacgaccggtgctcgatttagtagtgtagatttgggtttggggatcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttatggtggataaagccacgagcacagtctacatgcagctgagcagcctgagacacaacgacacggccgtctattattgttccagagataatcgcgtgaataaagatatggaa

SEQ ID NO: 464596 - DNA, 429 bp, Homo sapiens; identical to SEQ ID NO: 447944
  misc_feature: HEFZJCU01AUEH2.4.37.D04.1.454.heavy.3.raw

SEQ ID NO: 464597 - DNA, 371 bp, Homo sapiens
  misc_feature: HEFZJCU01CHGLK.3.42.D09.1.454.heavy.3.raw
agacgcactccacgaccggtgctcgatttagacacatacgcagggaaggggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacgggccgtgtaacgttggactactggggccagggaaccgtggtcaccgtctcctcagcctccaccaagggcccatcggtcttccccctggcaccctcctccaagagtacctctgggggcacagcggccctgggctgcctggtcaaggactacttccgagtgcgtct

SEQ ID NO: 464598 - DNA, 511 bp, Homo sapiens
  misc_feature: HEFZJCU01BWLI3.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagcgtggtttcctgttgctatttaaaaggtgcccagtgtgaggtgcagctggtggagtctggaggaggcttgatccagcctggagggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtcgtggggccaac

SEQ ID NO: 464599 - DNA, 516 bp, Homo sapiens
  misc_feature: HEFZJCU01B6VJ1.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtcccgccggcaagggactggagtatattggacgaatctatgccagtgggaccgccatctacaacccgtccctcaagagtcgagtcagcatgtcagtcgacacgtccagaaccagttctccctgacagtgagttatatgaccgccgcagacacggccgtgtattactgtgcgagagaggccgttattttaggaccagctagttaaaactcctactacggtctggacgtctgggccagggaccaa

SEQ ID NO: 464600 - DNA, 533 bp, Homo sapiens
  misc_feature: HEFZJCU01AQUHP.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaaccaggtggtccttacaatgaccaccatggaccctgtggacacagccacatatttctgtgcacactctataggagcacctggtagtctgccaaactggttcgacccctggggcccgggaaccctggtcaccgtctcctcagcctccaccaagggcccatcggtctcccctc

SEQ ID NO: 464601 - DNA, 316 bp, Homo sapiens; identical to SEQ ID NO: 444479
  misc_feature: HEFZJCU01BQFPC.47.84.H07.1.454.heavy.3.raw

SEQ ID NO: 464602 - DNA, 495 bp, Homo sapiens
  misc_feature: HEFZJCU01DX88X.11.71.G05.1.454.heavy.3.raw
cgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggccacacgctgtatctgcaaatgaacagcctgagagctgaggacacggctgtgtattactgtgacgaaagatttctata

SEQ ID NO: 464603 - DNA, 517 bp, Homo sapiens; identical to SEQ ID NO: 446891
  misc_feature: HEFZJCU01EUNJH.17.33.C11.1.454.heavy.3.raw

SEQ ID NO: 464604 - DNA, 517 bp, Homo sapiens
  misc_feature: HEFZJCU01EN84H.9.34.D01.1.454.heavy.3.raw
tgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggccctggctgcctggtcaaggactacttccagacgtatca

SEQ ID NO: 464605 - DNA, 522 bp, Homo sapiens
  misc_feature: HEFZJCU01DOVKD.26.71.G05.1.454.heavy.3.raw
agactatactcacgaccggtgctcgatttagtgtcgtcgcaagagagaggggggggaagaggaagactgacggtcctgcgctggtggagcccacgcagaccctcacgctgacctgctccgtctctggattctcactcaccacgactgaggtgaatgtggcctgggtccgtcaggccccggaaaggccctggagtggcttgcactcatttactggagtgatctcaagcggtacaatccgtctctgaggaatcgactcaccatcaccagggacacctccaaagaccgggtggtccttacaatgaccgacatgaatcctgtggacacaggcacatattactgtgcacacagtcctagcggctacgcgagaaaagaatatgactattgggccagggaatttgggtcaccgtctccccagcctccaccaagggcccatcggtcttcccctggcgccctcgctccaggacgcacctcccgagagcacgagcggcccgtgggctgcctggtcaaggactacttcctacg

SEQ ID NO: 464606 - DNA, 502 bp, Homo sapiens; identical to SEQ ID NO: 448798
  misc_feature: HEFZJCU01EFT1D.47.55.E11.1.454.heavy.3.raw

SEQ ID NO: 464607 - DNA, 514 bp, Homo sapiens
  misc_feature: HEFZJCU01CCUPT.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccacaaggccatcggtcttcccctggcaccctcctccaagagcacctctgggggcacagcggccctggctgcctggtcaaggactacttccagacgtatca

SEQ ID NO: 464608 - DNA, 408 bp, Homo sapiens; identical to SEQ ID NO: 457246
  misc_feature: HEFZJCU01BI3OD.40.22.B11.1.454.heavy.3.raw

SEQ ID NO: 464609 - DNA, 497 bp, Homo sapiens; identical to SEQ ID NO: 445179
  misc_feature: HEFZJCU01ENTGT.12.55.E11.1.454.heavy.3.raw

SEQ ID NO: 464610 - DNA, 519 bp, Homo sapiens
  misc_feature: HEFZJCU01B3DLK.12.33.C11.1.454.heavy.3.raw
atacgacgtacacgaccggtgctcgatttagagtgagctcgttgggtttggggggaagaggaagactgacggtccccccaggagttcaggtgctgggcacggtgggcatgtgtgagttttgtcacaagatttgggctcaactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccgaagggaccgacggtcatcgtctcctcagcctccaccaaggcccatcggtcttcccctcggcaccctcctccaagagcacctctgggggc

SEQ ID NO: 464611 - DNA, 506 bp, Homo sapiens
  misc_feature: HEFZJCU01DKQ3M.14.21.B10.1.454.heavy.3.raw
cgtctagtaccacgaccggtgctcgatttagtgtcgtcgcaggagagaggagcccagccctgggattttcaggtgttttcattcggtgatcaggactgaacagagagaactcaccatggagtttgggctgagcgtggcttttcttgtggctattttaaaaggtgtgcagtgtgaggtgcagctgttggagtctgggggaggcttggtacagcctggggggtccctgagactctcctgtgcagcctctggattcgtctttagcagctatgccatgagctgggctcgccaggctccagggaaggggctggagtgggtctctgctattcctggcagtggtgatatcgaatactacgcagactccgtgaagggccggttcactgtttccagagacaattccaagaacacactgtatctgcagatgaccagcctgagagccgaggacacggccgtatattactgtgcgaaacgccaagatttttggagtggttattatacctttgacttcg

SEQ ID NO: 464612 - DNA, 506 bp, Homo sapiens
  misc_feature: HEFZJCU01EZBBY.51.21.B10.1.454.heavy.3.raw
cgatcgtatacacgaccggtgctcgatttagtgtcgtcgcaagggggagggcatcatccaacaaccacatcccttctctacagaagcctctgagaggaaagttcttcaccatggactggacctggagggtcttctgcttgctggctgtagctccaggtgctcactccctggtgcagctggtgcagtctggggctgaggtgaagaagcctggggcctcagtgacgatttcctgtaggacatctggatacacgttcaccggctattttatgtactgggtgcgacaggcccctggacaaggccttgagtggatgggaaagatcaaccctagtggtggtaccacaagttacgcccagaaattccagggcagagtctccatgaccagaaatacgtccgcgaggacagtctacatggagttgagcagcctgagaactgacgacacggccatatattactgtgcgagagacctgctggtcctttgacttctgggccaggaacctggtctaccg

SEQ ID NO: 464613 - DNA, 508 bp, Homo sapiens
  misc_feature: HEFZJCU01CYF8S.11.57.F02.1.454.heavy.3.raw
cgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgccaggctccaggtaaggggctggaatggatttcatacattagcaagtagtggtgcgaccatatactacgcagactctgtgaagggccgattcatcatctccagagacaatggcaacaactcactgtatctggaaatcaacagcctagagagtcgaggacacgg

SEQ ID NO: 464614 - DNA, 506 bp, Homo sapiens
  misc_feature: HEFZJCU01EE3L1.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggcttttcttgtggctattttaaaaggtgtccagtgtgaggtgcagctgttggagtctggggggaggcttggcacagcctggggggtccctgagactctcctgtgcagcctctggattcacctttagtgcctatgccatgagctgggtccgccaggctccagggaaggggctagaatgggtctcaagtatcacaagcagtagtagtaccgcatggtacgcagacttcgtgaagggccgtttcacctatctccagagacaattccaaagaacacgctgtatttgcaaatgaaacagtctgagagtcgaggacacggccatatattactgtgcgaagcgggaattgggtggcggtgactgctattgactacgtc

SEQ ID NO: 464615 - DNA, 510 bp, Homo sapiens
  misc_feature: HEFZJCU01EGEXY.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgacgcctacggcagcggctttgacttcgtggggccaggggacg

SEQ ID NO: 464616 - DNA, 522 bp, Homo sapiens
  misc_feature: HEFZJCU01A5U39.12.33.C11.1.454.heavy.3.raw
atacgacgtacacgaccggtgctcgatttagagtgagctcgttgggtttggggggaagaggaagactgacggtccccccaggagttcaggtgctgggcacggtgggcatgtgtgagttttgtcacaagatttgggctcaactctcatgtgcagggtctggattcaactttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctgggccaagggaccacgggtcatcgtctcctcagcctccaccaaggcccatcggtcttcccctggcaccctcctccaagagcacctctggggcacagcc

SEQ ID NO: 464617 - DNA, 463 bp, Homo sapiens; identical to SEQ ID NO: 446208
  misc_feature: HEFZJCU01DVJHE.19.10.A10.1.454.heavy.3.raw

SEQ ID NO: 464618 - DNA, 508 bp, Homo sapiens; identical to SEQ ID NO: 460951
  misc_feature: HEFZJCU01D9007.16.34.D01.1.454.heavy.3.raw

SEQ ID NO: 464619 - DNA, 520 bp, Homo sapiens
  misc_feature: HEFZJCU01EGZAY.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagccctccaccaagggcccatcggtctcccctgcg

SEQ ID NO: 464620 - DNA, 508 bp, Homo sapiens; identical to SEQ ID NO: 445594
  misc_feature: HEFZJCU01B4OFZ.17.25.C03.1.454.heavy.3.raw

SEQ ID NO: 464621 - DNA, 511 bp, Homo sapiens
  misc_feature: HEFZJCU01D6YUK.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatagaacagcctgaagaccgaggacacagccgtctattactgtgttagggagttttacgtatttttggt

SEQ ID NO: 464622 - DNA, 510 bp, Homo sapiens
  misc_feature: HEFZJCU01BMB97.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggcgtggtccagcctgggaggtccctgagactctcctgtgcaggctctggattcaccttcagtaactacggcgtgcactgggtccgccaggctccaggcaagggcttggagtggctggcagttgttcatctgaaggaagtgttcaatactatacagactccgtgaagggccgattcaccatctccagagacaattccaagaacacgatgtatctgcaaatggacagcctaagagttgaggacacggctgtttattactgtacgaaggaggggggatacgagtggcagctccaagtacttacg

SEQ ID NO: 464623 - DNA, 511 bp, Homo sapiens
  misc_feature: HEFZJCU01D4DV9.12.14.B03.1.454.heavy.3.raw
atacgacgtacacgaccggtgctcgatttagtgtgagtagtttgagtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttccccctggccaccctcctccaagagcacctctgggggcacagcggccctgggctgcctggtcaaggactacttcctacgtcgtat

SEQ ID NO: 464624 - DNA, 538 bp, Homo sapiens
  misc_feature: HEFZJCU01B85O0.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggccgtttattacgtgtgcggagaggggacgggactacgggtgacgttacgtgggggtttcgacccctgggggccaggggaaccctggtcaccgtctcctcagcctccaccg

SEQ ID NO: 464625 - DNA, 499 bp, Homo sapiens; identical to SEQ ID NO: 446805
  misc_feature: HEFZJCU01CBOYE.3.20.B09.1.454.heavy.3.raw

SEQ ID NO: 464626 - DNA, 406 bp, Homo sapiens; identical to SEQ ID NO: 454861
  misc_feature: HEFZJCU01CYL6T.17.37.D04.1.454.heavy.3.raw

SEQ ID NO: 464627 - DNA, 504 bp, Homo sapiens
  misc_feature: HEFZJCU01BOY74.26.80.H03.1.454.heavy.3.raw
agactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaagtgaagaagcctggggcctcagtgaaggtctcctgcaaggcttctggatacaccttctaccgcctactatatccactgggtgcggcaggcccctggacaagggcttgagtggatgggacacatcagccctaacactggtgacacaaactatgcacagagatttcagggcagggtcaccatgaccacggacacgtccataagcacagtttacatggaggtaaataggctgagatctgacgacacggccgtatattactgtgcgttattaacggacgattacgatgttttgattggtttttacg

SEQ ID NO: 464628 - DNA, 347 bp, Homo sapiens
  misc_feature: HEFZJCU01CS2WZ.52.38.D05.1.454.heavy.3.raw
cgcagtacgacacgaccggtgctcgatttagtatctgatagttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagca

SEQ ID NO: 464629 - DNA, 519 bp, Homo sapiens
  misc_feature: HEFZJCU01CEVBP.8.34.D01.1.454.heavy.3.raw
ctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtattggacctgaacagcctaagtcctgaggacacgggtgtatactactgtacgtaaggaggggggaaccgaggcggggagttaccgaagtacc

SEQ ID NO: 464630 - DNA, 513 bp, Homo sapiens; identical to SEQ ID NO: 446452
  misc_feature: HEFZJCU01C4YE4.17.33.C11.1.454.heavy.3.raw

SEQ ID NO: 464631 - DNA, 503 bp, Homo sapiens; identical to SEQ ID NO: 461769
  misc_feature: HEFZJCU01BQPFB.17.25.C03.1.454.heavy.3.raw

SEQ ID NO: 464632 - DNA, 511 bp, Homo sapiens
  misc_feature: HEFZJCU01EJ4QJ.40.12.B01.1.454.heavy.3.raw
tctagcgactcacgaccggtgctcgatttagtagtgtagattccgcggggatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctcgaccactcggggccaggggtaaacccg

SEQ ID NO: 464633 - DNA, 519 bp, Homo sapiens
  misc_feature: HEFZJCU01D70Q3.47.78.H01.1.454.heavy.3.raw
agctcacgtacacgaccggtgctcgatttagtgtgagtagtttgggtttggggctctgggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtctgggggaggcctcataaagccgggggggtcccttaaactctcctgcgcagcgtctggatttcctttcagtcaagtctggataagctgggtccgccaggctccagggatgggcctggagtgggttggccgtgtcaagagcagaactgatggtgcgacatctgaatacgctgcacccgtgaaaggcagattcaccatctccagagatgattcaaataaatatgtcatatctacaaatggatagcctgaaaatcgaggatacaggtgtttattactgttccacagggaatgcggttctctggggccgagggact

SEQ ID NO: 464634 - DNA, 506 bp, Homo sapiens
  misc_feature: HEFZJCU01ATQ7M.13.67.G01.1.454.heavy.3.raw
  modified_base (483)..(483): a, c, t, g, unknown or other
tcacgtactacacgaccggtgctcgatttagagtatacatattgggtttgggggggagaggagccccagccctgagattcccacgtgttgccattcggtgatcagcgctgaacacagaggactcgccatggagtttgggctgagcgtggtttcgttgtaggctatttaaaaggtgtccagtgtgaggtgcagctggtagagtctgggggaggtgtggtacggcctggggggtccctcagactctcctgtgcaacctctggattcagatttgatgagtatggcatacactgggtccgccaacctccagggaaggggctgcagtgggtctctggtataaactggaatggtgccagcacaacttatgcagactctgtgaagggccgattcaccatctccagagacagtgccgagaactccgtacatctgcaaatgaacagtctcggagtcgaggacacggccttgtatttctgtgcgaggttagcngtggctggtacttacgctaatgg

SEQ ID NO: 464635 - DNA, 524 bp, Homo sapiens
  misc_feature: HEFZJCU01D0C6C.13.65.F10.1.454.heavy.3.raw
tcacgtactacacgaccggtgctcgatttagctacgctctaaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacattctgacgacacggccatatattactgtgcgagaaggacggtttttggggcgcggactcctcttgagatcgtggggccagggggacaatggtcaccgtctcttcag

SEQ ID NO: 464636 - DNA, 336 bp, Homo sapiens; identical to SEQ ID NO: 444510
  misc_feature: HEFZJCU01ECFQZ.3.31.C09.1.454.heavy.3.raw

SEQ ID NO: 464637 - DNA, 499 bp, Homo sapiens; identical to SEQ ID NO: 447220
  misc_feature: HEFZJCU01CAGFB.12.14.B03.1.454.heavy.3.raw

SEQ ID NO: 464638 - DNA, 491 bp, Homo sapiens; identical to SEQ ID NO: 444592
  misc_feature: HEFZJCU01DOER9.11.26.C04.1.454.heavy.3.raw

SEQ ID NO: 464639 - DNA, 526 bp, Homo sapiens; identical to SEQ ID NO: 446836
  misc_feature: HEFZJCU01ENXJE.11.25.C03.1.454.heavy.3.raw

SEQ ID NO: 464640 - DNA, 394 bp, Homo sapiens
  misc_feature: HEFZJCU01DBW2J.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctagcgcacttctttgacttctggggccagggaatcctggtcaccgtctccacagcctccaccaagggcccatcggtcttcccctggcgccctgctccaggagcacctccgagagcacagcggccctgggctgcctggtcaaggactacttcctacgtgagct

SEQ ID NO: 464641 - DNA, 536 bp, Homo sapiens
  misc_feature: HEFZJCU01BUINJ.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctcaccaagggcccatcggtcttcccctggcaccctcctccaagagcacctctgggggcacagcc

SEQ ID NO: 464642 - DNA, 529 bp, Homo sapiens
  misc_feature: HEFZJCU01DCOR7.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacgggctgtttattactgtacgaaagagggggatacagtggcagctccaagtactactttgacttctggggccagggaaccctggtcaccgtctcctcagcctccaccaagggcccatcggtcttcccctggcgccctgctccaggacgcacctccgagacg

SEQ ID NO: 464643 - DNA, 517 bp, Homo sapiens
  misc_feature: HEFZJCU01AW02R.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaaggcccatcggtccttcccctggccaccctcctccaagagcacctctgggggcacagcggcctggctgcctggtcaaggactacttcctagagacacg

SEQ ID NO: 464644 - DNA, 396 bp, Homo sapiens; identical to SEQ ID NO: 444469
  misc_feature: HEFZJCU01BPT0A.47.46.E02.1.454.heavy.3.raw

SEQ ID NO: 464645 - DNA, 505 bp, Homo sapiens
  misc_feature: HEFZJCU01C1BQR.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagtcttttgactactggggccagggaaccctggtcatcgtctcctcagcctccaccaagggcccatcggtcttcccctggcaccctcctccaagagcacctctgggggcacagcggcctgggctgcctggtcaaggactacttccgagtagtac

SEQ ID NO: 464646 - DNA, 512 bp, Homo sapiens
  misc_feature: HEFZJCU01D9K00.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccagggaacccgtc

SEQ ID NO: 464647 - DNA, 505 bp, Homo sapiens; identical to SEQ ID NO: 454358
  misc_feature: HEFZJCU01DECEV.11.57.F02.1.454.heavy.3.raw

SEQ ID NO: 464648 - DNA, 503 bp, Homo sapiens
  misc_feature: HEFZJCU01CW0KO.17.10.A10.1.454.heavy.3.raw
  modified_base (448)..(448): a, c, t, g, unknown or other
  modified_base (462)..(462): a, c, t, g, unknown or other
  modified_base (501)..(501): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgaacgacacggccgtctattacctgtncgagaatgttttcngtcatcgtacaatttgataggctctatggactggacttntc

SEQ ID NO: 464649 - DNA, 513 bp, Homo sapiens
  misc_feature: HEFZJCU01A1GG7.4.25.C03.1.454.heavy.3.raw
agcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgtttctgcaaatgaacagcctgagagccgaggacacggctgtgtatcactgtgtcagagatgccgagggcggttacccctctggttccttcgacagttatggtatggacgtcgtggggcctagggactacggtcaccgtctcctcagcctccaccaaggcccatcggtcttcccctggca

SEQ ID NO: 464650 - DNA, 522 bp, Homo sapiens
  misc_feature: HEFZJCU01EJXVS.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggccaggggaccctggtcatcgtctccccagcctccaccaagggcccatcggtcttcccctggcg

SEQ ID NO: 464651 - DNA, 479 bp, Homo sapiens
  misc_feature: HEFZJCU01B56DW.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaaggtcgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggccatcgtcttcccctggcaccctcctccaagagcacctctgggggcacagcggccctgggctgcctggtcaaggactacttcctagagacacg

SEQ ID NO: 464652 - DNA, 520 bp, Homo sapiens
  misc_feature: HEFZJCU01B5NO7.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggatacagtggcagctccaagtactactttgacttctggggccagggaaccctggtcaccggtctcctcagcctccaccaagggccatcggtcttcccctgcgcctgctccaggagcacctccg

SEQ ID NO: 464653 - DNA, 504 bp, Homo sapiens; identical to SEQ ID NO: 455206
  misc_feature: HEFZJCU01AWRVE.47.81.H04.1.454.heavy.3.raw

SEQ ID NO: 464654 - DNA, 523 bp, Homo sapiens
  misc_feature: HEFZJCU01ET8YU.11.25.C03.1.454.heavy.3.raw
cgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgttcttcaaatgaacagcctgagagccgatgacacggccgtgtattactgtgcgagagatggggcccacgaacgttactacgctatggacgtctggggccaagggaccac

SEQ ID NO: 464655 - DNA, 511 bp, Homo sapiens
  misc_feature: HEFZJCU01DVVSV.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactacttttgactactggggccg

SEQ ID NO: 464656 - DNA, 508 bp, Homo sapiens
  misc_feature: HEFZJCU01DIS0C.10.85.H08.1.454.heavy.3.raw
  modified_base (474)..(474): a, c, t, g, unknown or other
catagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaagggctggagtggtggccaccataaaggaagatggaagtgagaactacttgtggctctgtgaagggccgattcaccatctccagagacaacgccaagaagtcactgtatctgcaaatgaacgatgtgagagtcgaggacacggctgtatatttctgtgcgaggggnccggctagtggttcggacctgtggggccagggta

SEQ ID NO: 464657 - DNA, 512 bp, Homo sapiens
  misc_feature: HEFZJCU01CLCU1.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccacttttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagaccgctacgtggggcccgggagcccctggt

SEQ ID NO: 464658 - DNA, 485 bp, Homo sapiens
  misc_feature: HEFZJCU01CRSLQ.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaagaggtgtccagtgtcaggtgcgcctggtggagtcggggggagcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattg

SEQ ID NO: 464659 - DNA, 533 bp, Homo sapiens
  misc_feature: HEFZJCU01DMX8J.11.10.A10.1.454.heavy.3.raw
cgagagataccacgaccggtgctcgatttagcgtcgatctcaggggctgtcgtgatgattgcgtggtgggactctgtcccgctccaaggcacccgctctctgggacgggtgccccccggggtttttggactcctgggggtgacttagcagccgtctgcttgcagttggacttcccaggccgacagtggtctggcttctgaggggtcaggccagaatgtggggtacgtgggaggccagcagagggttccatgagaagggcaggacagggccacggacagtcagcttccatgtgacgcccggagacagaaggtctctgggtggctgggtttttgtggggtgaggatggacattctgccattgtgattactactactactactacatggacgtctggggcaaagggaccacggtcaccgtctcctcagcctccaccaagggcccatcggtcttcccctggcaccctcctccaagagcacctctgggggcacagcggccctgggctgcctggtcaaggactactccgtatctctcgc

SEQ ID NO: 464660 - DNA, 518 bp, Homo sapiens
  misc_feature: HEFZJCU01ENTR4.12.33.C11.1.454.heavy.3.raw
atacgacgtacacgaccggtgctcgatttagagtgagctcgttgggtttggggggaagaggaagactgacggtccccccaggagttcaggtgctgggcacggtgggcatgtgtgagttttgtcacaagatttgggctcaactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttcccctggccaccctcctccaagagcacctctgggggc

SEQ ID NO: 464661 - DNA, 496 bp, Homo sapiens; identical to SEQ ID NO: 444697
  misc_feature: HEFZJCU01AHL40.16.37.D04.1.454.heavy.3.raw

SEQ ID NO: 464662 - DNA, 523 bp, Homo sapiens; identical to SEQ ID NO: 445239
  misc_feature: HEFZJCU01EKKB9.9.78.H01.1.454.heavy.3.raw

SEQ ID NO: 464663 - DNA, 472 bp, Homo sapiens
  misc_feature: HEFZJCU01DN201.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgacctaacagcggtggcacaaagtatgcacagaagtttcagggcagggtcaccatgaccagggacacgtccatcagcacgtccatcagcacagcctacatggacctgagcggcctggacatctgacgacacggccgtatatttctgt

SEQ ID NO: 464664 - DNA, 500 bp, Homo sapiens; identical to SEQ ID NO: 446033
  misc_feature: HEFZJCU01ER94A.11.27.C05.1.454.heavy.3.raw

SEQ ID NO: 464665 - DNA, 379 bp, Homo sapiens; identical to SEQ ID NO: 444450
  misc_feature: HEFZJCU01DA56J.47.77.G11.1.454.heavy.3.raw

SEQ ID NO: 464666 - DNA, 520 bp, Homo sapiens
  misc_feature: HEFZJCU01ELC1Y.12.71.G05.1.454.heavy.3.raw
  modified_base (417)..(417): a, c, t, g, unknown or other
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctgggccagggaacccaggtcaccgtctcctcngcctccaccaagggcccatccgtcttcccctggcgccctgctccaggagcacctccgagagcacagcggccctgggctgcctggtcaaggactacttcctacg

SEQ ID NO: 464667 - DNA, 373 bp, Homo sapiens
  misc_feature: HEFZJCU01DIWP1.5.23.C01.1.454.heavy.3.raw
atcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagaggggaccacggtcatcgtctcctcagcctccaccaagggcccatcggtcttccccctggcaccctcctccaagagcacctctgggggcacagcggccctgggctgcctggtcaaggactacttcccgtgtctgat

SEQ ID NO: 464668 - DNA, 487 bp, Homo sapiens; identical to SEQ ID NO: 447190
  misc_feature: HEFZJCU01DBY2B.3.48.E04.1.454.heavy.3.raw

SEQ ID NO: 464669 - DNA, 429 bp, Homo sapiens; identical to SEQ ID NO: 447944
  misc_feature: HEFZJCU01AOVFU.4.37.D04.1.454.heavy.3.raw

SEQ ID NO: 464670 - DNA, 533 bp, Homo sapiens
  misc_feature: HEFZJCU01D44G5.16.86.H09.1.454.heavy.3.raw
  modified_base (526)..(526): a, c, t, g, unknown or other
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccacgcaccccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctcgatagctagtggctggtccacttaggtttgactactgggggcccaggggaagcctttggtccaccggtctccctnacgccct

SEQ ID NO: 464671 - DNA, 522 bp, Homo sapiens
  misc_feature: HEFZJCU01CNX2S.10.85.H08.1.454.heavy.3.raw
  modified_base (482)..(482): a, c, t, g, unknown or other
catagtagtgcacgaccggtgctcgatttagtatcactcagtcgcgggggtctcagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggganccgggctatggttcggacctcgtggggccagggtaacccg

SEQ ID NO: 464672 - DNA, 482 bp, Homo sapiens; identical to SEQ ID NO: 445068
  misc_feature: HEFZJCU01EWEW3.11.23.C01.1.454.heavy.3.raw

SEQ ID NO: 464673 - DNA, 491 bp, Homo sapiens; identical to SEQ ID NO: 447127
  misc_feature: HEFZJCU01DZF0W.12.75.G09.1.454.heavy.3.raw

SEQ ID NO: 464674 - DNA, 501 bp, Homo sapiens
  misc_feature: HEFZJCU01EVBGR.40.81.H04.1.454.heavy.3.raw
  modified_base (454)..(454): a, c, t, g, unknown or other
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgatttacngttggaagagacgttggtggctaccgcggggctgaccactggggccg

SEQ ID NO: 464675 - DNA, 521 bp, Homo sapiens; identical to SEQ ID NO: 445317
  misc_feature: HEFZJCU01D9LAU.12.40.D07.1.454.heavy.3.raw

SEQ ID NO: 464676 - DNA, 530 bp, Homo sapiens
  misc_feature: HEFZJCU01A1X7Q.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaatgaacagcctgagaaccgaggacacagccgtgtattactgtaccacatccctgaaagcgtcaactactactactacggtatggacctctgggg

SEQ ID NO: 464677 - DNA, 495 bp, Homo sapiens
  misc_feature: HEFZJCU01DR98S.48.20.B09.1.454.heavy.3.raw
agtatacatacacgaccggtgctcgatttagtgtagtgtgaagggggagcacaattgaaaaagcccggggagtctctgaagatctcctgtgagggttctggatacagctttgccaactactggatcgcctgggtgcgccagatgcccgggaaaggcctggagtggatggggatcatctatcctggcgactctgataccagatacagcccgtccttccaaggccaagtcaccatctcagccgacaactccatcagcaccgcctacctgcagtggagcagcctgaaggcctcggacaccgccgtgtattactgtgcgagacatgattacggctactcacgtccgcactactggggccagggaaccctggtcaccgtctcctcagcttccaccaagggcccatcggtccttcccctggccgccctcgctccaggagcacctctgggggcacgagccggccctgggctgcctggtcaaggactacttctactgtatact

SEQ ID NO: 464678 - DNA, 530 bp, Homo sapiens
  misc_feature: HEFZJCU01COJ1N.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgttacgagagcgtcgtctgtcagtgaattgactactgggccagggaccctggtcaccgtctcctcagcctccaccaaggg

SEQ ID NO: 464679 - DNA, 491 bp, Homo sapiens
  misc_feature: HEFZJCU01C6K6S.51.52.E08.1.454.heavy.3.raw
cgatcgtatacacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagcctggggcctcagtgaaggtctcctgcaagacttctggatacaccttcaccgactactatatgcactgggtgcgacaggcccctggacaagggcttgagtggatgggatggatcgaccctaagaatgggtgccacaaactatgcacagacttttcagggctgggtcaccatgaccaagcgacacatactagcaacaccagtctacatggagttgaccagcctgaccgacacggccgtgtatttttgtgtgagagattttcggacaatccagagacccct

SEQ ID NO: 464680 - DNA, 511 bp, Homo sapiens
  misc_feature: HEFZJCU01D0P0Z.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaccagttctccctgacagtgagttatatgaccgccgcagacacggccgtgtattactgtgcgagagaggccgttattttaggaccagctgttaaaactcctactacggtctggacgtcgtggggccaggg

SEQ ID NO: 464681 - DNA, 500 bp, Homo sapiens; identical to SEQ ID NO: 445807
  misc_feature: HEFZJCU01BO6CM.40.81.H04.1.454.heavy.3.raw

SEQ ID NO: 464682 - DNA, 516 bp, Homo sapiens
  misc_feature: HEFZJCU01ALG7T.48.53.E09.1.454.heavy.3.raw
agtatacatacacgaccggtgctcgatttagagagagtgtgttgggtttggggatgctttctgagagtcatggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactgggcctggatccgccagccccccgggaagggactggaatggattgggagtatctattatacagggagcacctactacaacccgtccctcaagagtcgagtcaccatctccgcagacacgtccaagaaccagttctccctgaggctgagctctgtgaccgccgcagacacggctgtctattactgtgcgagaagtgggtcgtggcagtggctggtacgtggctctcagtggttccgaccccgtgggggcccaggggactaccgt

SEQ ID NO: 464683 - DNA, 522 bp, Homo sapiens; identical to SEQ ID NO: 460830
  misc_feature: HEFZJCU01EQKPT.49.59.F04.1.454.heavy.3.raw

SEQ ID NO: 464684 - DNA, 506 bp, Homo sapiens
  misc_feature: HEFZJCU01DLLXG.21.4.A04.1.454.heavy.3.raw
  modified_base (454)..(454): a, c, t, g, unknown or other
  modified_base (489)..(489): a, c, t, g, unknown or other
tcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtctgggggagacttggtccagcctggagggtccctgagactctcctgtgcagcctctgcattcaccttcagtgaccacaacatggactgggtccgccaggctccaggaaggggctggagtgggtcggccgtattacaaggaaagctaacagttacagtacagaatacggcgcgtctgtgaaaggaaggttcaccatctcaagagatgattcaaagaactcactgtatctgcaaatgaacagcctagaaaaccgnggacacggccgtgtattattgtggtagacaaaagngtggatgtggtgtagct

SEQ ID NO: 464685 - DNA, 524 bp, Homo sapiens; identical to SEQ ID NO: 445902
  misc_feature: HEFZJCU01AWE7C.9.78.H01.1.454.heavy.3.raw

SEQ ID NO: 464686 - DNA, 522 bp, Homo sapiens
  misc_feature: HEFZJCU01EBYUM.12.33.C11.1.454.heavy.3.raw
  modified_base (520)..(520): a, c, t, g, unknown or other
atacgacgtacacgaccggtgctcgatttagagtgagctcgttgggtttgggagaggagccccagccctgagattcccacgtgtttccatccagtgatcagcactgaacacagaggactcgccatggagtctgggctgaactgggttttccttgttgctattttaaaaggtgtccactgtgaggtgcaactggtggagtcggggggaggtgtagtacggccgggggggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggaacaatttgagagaggaagacacggccttatatttctgtgcgagagccctcggcagaagtctggactactactattatggtatggacgtntc

SEQ ID NO: 464687 - DNA, 396 bp, Homo sapiens; identical to SEQ ID NO: 444469
  misc_feature: HEFZJCU01CGWT9.47.46.E02.1.454.heavy.3.raw

SEQ ID NO: 464688 - DNA, 480 bp, Homo sapiens
  misc_feature: HEFZJCU01ECLLG.52.56.F01.1.454.heavy.3.raw
cgcagtacgacacgaccggtgctcgatttagcagacgtctgaacacacaaaggggctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatgggaagcaagatatactatgtagactccgtgaagggccgattcatcatctccagagacaactccgagaacacgctgtatctgcaaatgaacaggctgagagctgaagacacggctgtatattactgtgacg

SEQ ID NO: 464689 - DNA, 528 bp, Homo sapiens
  misc_feature: HEFZJCU01EH9QR.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtcctcaagagtcgagtaacgatctcagtggacacgtctaacaatcacctctccctgaggctgagctctgtgacagccgcggacacgggcgtttattactgtgcgagagggacggactacggtgactacgtgggggttcgaccccgtggggccaggggaaccctggtcaccgtctcctcagcctccaccg

SEQ ID NO: 464690 - DNA, 519 bp, Homo sapiens
  misc_feature: HEFZJCU01END2G.49.9.A09.1.454.heavy.3.raw
agtcgagagacacgaccggtgctcgatttagcgagacgcgcagggggagccccagccctgggattcccagctgtttctgcttgctgatcaggactgcacacagagaactcaccatggagtttgggctgacctgggttttccttgttgctattttaaaaggtgtccagtgtgaagggcagctggtggagtccgggggaggcttggttcagcctggggggtccctaagactctcctgtgcagcctctggaatcgccttcaataagttttggatgtactgggtccgccaagttccagggaagggctgatgtgggtctcacgtattgatgttgatggggagttacagtgaccacgcggactctgtgaagggccgattcaccgtctccagagaaaacgccaagaacacggtgtatctgcaaatgactggcctgagagccgaggacacgggcagtttattactgtgcaagagcttgtggtcgactgtcgacctggactggtacttgatctgtggggccgtggcta

SEQ ID NO: 464691 - DNA, 520 bp, Homo sapiens; identical to SEQ ID NO: 451524
  misc_feature: HEFZJCU01BFCK5.14.57.F02.1.454.heavy.3.raw

SEQ ID NO: 464692 - DNA, 470 bp, Homo sapiens; identical to SEQ ID NO: 444866
  misc_feature: HEFZJCU01DZLZX.4.36.D03.1.454.heavy.3.raw

SEQ ID NO: 464693 - DNA, 497 bp, Homo sapiens
  misc_feature: HEFZJCU01BY10G.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaaccaggtggtccttacaatgaccaacatggaccctgtggacacagccacatattactgtgcacagagatacgggcagcacgtggtttggggctactggggccagggaaccctggtcaccgtctcctcagccctccaccg

SEQ ID NO: 464694 - DNA, 520 bp, Homo sapiens
  misc_feature: HEFZJCU01CHOCA.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtgtcatagacctaggatacaacgacggtggtacctggtacttcc

SEQ ID NO: 464695 - DNA, 489 bp, Homo sapiens
  misc_feature: HEFZJCU01DYR5K.40.85.H08.1.454.heavy.3.raw
tctagcgactcacgaccggtgctcgatttagtatcactcagtcgcggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccactggggccagggaaccctggtcaccgtctcctcagcctccaccaagggcccatcggtcttcccctggcgccctgctccaggagcacctccgagagcacagcggccctgggctgcctgtcaaggactacttccagtcgctaga

SEQ ID NO: 464696 - DNA, 509 bp, Homo sapiens
  misc_feature: HEFZJCU01DH7ZZ.51.58.F03.1.454.heavy.3.raw
cgatcgtatacacgaccggtgctcgatttagtctgatcgagaagggaaaggggctgggagacgagcccagcactcgaagtcgccggtgtttccattcggtgatcatcactgaacacagaggactcaccatggagtttgggctgagctgggttttcctcgttgctcttttaagaggtgtccagtgtcaggtgcggctggtggagtctgggggaggcgtggtccagcctggggattccctgagaatctcctgtgcagcctctggattcaacttcaatagacatcctatgcactgggtccgccaggctccagacaaggggctggaatgggtggcagttatttcgtccactggaaacagtaaacattatggacgctccgtgaagggcccattcgccatctccagagacaattccaaaaataccctctatctgcgaatgaacagcctgcgacctgaagacacggctatatatttctgtgcgagaggggagtcttattgtaatgatggttcctgt

SEQ ID NO: 464697 - DNA, 483 bp, Homo sapiens; identical to SEQ ID NO: 444924
  misc_feature: HEFZJCU01DNPIY.10.35.D02.1.454.heavy.3.raw

SEQ ID NO: 464698 - DNA, 499 bp, Homo sapiens
  misc_feature: HEFZJCU01AEBRQ.14.25.C03.1.454.heavy.3.raw
cgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtgggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacgggctgtgtattactgtgggagagatggaggtcgatagttgta

SEQ ID NO: 464699 - DNA, 490 bp, Homo sapiens
  misc_feature: HEFZJCU01CFO1J.11.38.D05.1.454.heavy.3.raw
cgagagataccacgaccggtgctcgatttagtatctgatagttgggtttgggggaggcttggtacagcctggggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagtggtggtagctgctactggggccagggaaccctggtcaccgtctcctcagcctccaccaagggcccatcggtctcccctggcaccctcctccaagagcacctctgggggcacagcggccctgggctgcctggtcaaggactacttccgtatctctcg

SEQ ID NO: 464700 - DNA, 525 bp, Homo sapiens
  misc_feature: HEFZJCU01AK6CZ.8.34.D01.1.454.heavy.3.raw
ctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggtccaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagacctaagtcctgaggacacgggcgtatactactgtacgaagggaggggggaaccaggcgggacgttaccgaagtacctcctttgacgtcgtc

SEQ ID NO: 464701 - DNA, 523 bp, Homo sapiens
  misc_feature: HEFZJCU01A3IT6.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacaccgtcccagaaccagttctccctgacagtgagttatatgaccgccgcagacacggccgtgtattactgtgcgagagaggccgttattttaggaccagctagttaaaactcctactacggtctggacgtcgtcggggccgaggggacctaa

SEQ ID NO: 464702 - DNA, 532 bp, Homo sapiens
  misc_feature: HEFZJCU01DHRWN.16.87.H10.1.454.heavy.3.raw
tgtactactccacgaccggtgctcgatttagcagtactgcgttgggtttgggggagccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtggaaacagtttatggttggggggagttggggttttttttcgttacgtacgggt

SEQ ID NO: 464703 - DNA, 521 bp, Homo sapiens
  misc_feature: HEFZJCU01DPI5K.40.67.G01.1.454.heavy.3.raw
tctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagtccccaggaaaggggctccaatgcgttggacatgtcaattcttatgggcgctcccactacagtgcggccctccagagtcgagccctcatatccatagacacgtccaagaaccagttttccctgacgctgacgtctgtgaccgccgcagacacggctgtctattattgtgcgagactagccttctgtagtgggggtacttgcaacccgggatactactccaccttcggcttggacatctgggccgaggggcctc

SEQ ID NO: 464704 - DNA, 429 bp, Homo sapiens; identical to SEQ ID NO: 447944
  misc_feature: HEFZJCU01D25RL.4.37.D04.1.454.heavy.3.raw

SEQ ID NO: 464705 - DNA, 511 bp, Homo sapiens
  misc_feature: HEFZJCU01EO0VD.27.57.F02.1.454.heavy.3.raw
agcgtcgtctcacgaccggtgctcgatttagctcgatatagttgggtttgaggtctcagagaggagccttagccctggactccaaggcctttccacttggtgatcagcacggagcacagaggacccaccatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccgagggaagggctggagttcgtggccaacataaaccaagatggaaggtaaagaaaactatgtggactctgtgaagggccgattcaccatctccagagacaacgccaagaagtcactgtatctgcaaatgaacagcctgagagaccgaggacacggctgtatactactgtgcgagagatcctagtctattccgtcttttgattcg

SEQ ID NO: 464706 - DNA, 520 bp, Homo sapiens; identical to SEQ ID NO: 453800
  misc_feature: HEFZJCU01E0VWR.3.82.H05.1.454.heavy.3.raw

SEQ ID NO: 464707 - DNA, 462 bp, Homo sapiens; identical to SEQ ID NO: 453861
  misc_feature: HEFZJCU01COA3B.19.10.A10.1.454.heavy.3.raw

SEQ ID NO: 464708 - DNA, 529 bp, Homo sapiens
  misc_feature: HEFZJCU01DXC86.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaaggcccatcgtcttcccctggcaccctcctccagagcacctctggggcac

SEQ ID NO: 464709 - DNA, 513 bp, Homo sapiens; identical to SEQ ID NO: 446452
  misc_feature: HEFZJCU01C50DA.17.33.C11.1.454.heavy.3.raw

SEQ ID NO: 464710 - DNA, 536 bp, Homo sapiens
  misc_feature: HEFZJCU01D8B21.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacatccctgaaacgcgtacaactactactactacggtatggacctcgtgggaccg

SEQ ID NO: 464711 - DNA, 549 bp, Homo sapiens
  misc_feature: HEFZJCU01DTR90.13.57.F02.1.454.heavy.3.raw
tcacgtactacacgaccggtgctcgatttagctcgatatagttgggtttggggtgggaaatactttctgagactcatggacctcctgcacaagaacatgaaacacctgtggttcttcctcctcctggtggcagctcccagctgggtcctgtcccaggtgcagctgcaggagtcgggcccaggactggtgaagccttcggggaccctgtccctaaattgcgctgtctctggtgactccatcagcggtagtaaatggtggagttgggtccgccagcccccagggaaggggctggagtggattggggaaatctttcatagcgggatcaccaactacaacccgtccctcaagagtcgagtcaccatatctatagacaagtccaagaaccacttctccctgaacgtgagttctgtgaccgccgcggacacggccgtgtattactgtgcgagaggattgtggttttactcttggttcaatgagttattatgtcttttgacttattggggccagggaaccctggtccaccgtctcctcagcctccacaacgggccc

SEQ ID NO: 464712 - DNA, 488 bp, Homo sapiens
  misc_feature: HEFZJCU01EB63W.12.75.G09.1.454.heavy.3.raw
atacgacgtacacgaccggtgctcgatttagtatagacatcagggggcatcacataacaaccacattcctcctctaaagaagcccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaggacagaagtcacgattaccgcggacgaatccacgaccacagcctacatagagctgcgcagcctgagatctgaagacacggccatttatactgtgcgagagatgcacgggccctacccacactcggtttta

SEQ ID NO: 464713 - DNA, 504 bp, Homo sapiens; identical to SEQ ID NO: 444560
  misc_feature: HEFZJCU01A7LQI.9.33.C11.1.454.heavy.3.raw

SEQ ID NO: 464714 - DNA, 405 bp, Homo sapiens; identical to SEQ ID NO: 445302
  misc_feature: HEFZJCU01BRAFR.3.17.B06.1.454.heavy.3.raw

SEQ ID NO: 464715 - DNA, 498 bp, Homo sapiens
  misc_feature: HEFZJCU01DD0PW.53.72.G06.1.454.heavy.3.raw
cgcgtatacacacgaccggtgctcgatttagctacgactgcaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacacgtccatcagcactgcctacatggagctgaccaggctgaaatttgaggacacggccatttattactgtgcaaggaacagcataatgactcgtccccggactttacg

SEQ ID NO: 464716 - DNA, 393 bp, Homo sapiens; identical to SEQ ID NO: 449969
  misc_feature: HEFZJCU01CL04H.5.70.G04.1.454.heavy.3.raw

SEQ ID NO: 464717 - DNA, 489 bp, Homo sapiens; identical to SEQ ID NO: 444791
  misc_feature: HEFZJCU01DVXDH.47.85.H08.1.454.heavy.3.raw

SEQ ID NO: 464718 - DNA, 537 bp, Homo sapiens
  misc_feature: HEFZJCU01DQ7Q2.16.39.D06.1.454.heavy.3.raw
tgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccagggaaggggctggaatgggtctcagttattgaaaatgatggtgacacaatctacgccgactccgtgaagggccgattcaccatctccagagacaattccaagaacacggtgaatcttcaaatgaacagcctgagaaccgaggacacggccgtatattattgtataggttatggtggtaattcgggccctggggccagggaaccgtggtcaccgtctcctcagcctccacac

SEQ ID NO: 464719 - DNA, 520 bp, Homo sapiens
  misc_feature: HEFZJCU01C2Q81.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggccagggaaccctggtgaccgtctcctcagcctccaccaagggcccatcggtcttcccctggccgccctgctccaggagcacctccgagagcacagcggccc

SEQ ID NO: 464720 - DNA, 502 bp, Homo sapiens; identical to SEQ ID NO: 445414
  misc_feature: HEFZJCU01DSA7K.17.25.C03.1.454.heavy.3.raw

SEQ ID NO: 464721 - DNA, 527 bp, Homo sapiens
  misc_feature: HEFZJCU01ATB6Q.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctgggccggggaaccctggtcaccgtctccccaccctccaccaagggcccatcggtcttccccctggcaccctcctccaacgagcacctctgggggcacagcggccctgggctgcctggtcaggactacttcccactactcgta

SEQ ID NO: 464722 - DNA, 384 bp, Homo sapiens
  misc_feature: HEFZJCU01CBSPL.48.67.G01.1.454.heavy.3.raw
agtatacatacacgaccggtgctcgatttagagtatacatattgggtttgggagtatctattatacagggagcacctactacaacccgtccctcaagagtcgagtcaccatctccgcagacacgtccaagaaccagttctccctgaggctgagctctgtgaccgccgcagacacggctgtctattactgtgcgagaagtgggtcgtggcagtggctggtacgtggctctcagtggttcgacccctggggccagggatacctggtcaccgtctcctcagcttccaccaaggcccatcggtcttcccctggcgccctgctccaggagcacctctggggcacagcggccctgggctgcctggtcaaggactacttcctatgtatact

SEQ ID NO: 464723 - DNA, 427 bp, Homo sapiens; identical to SEQ ID NO: 444708
  misc_feature: HEFZJCU01EYEWA.9.34.D01.1.454.heavy.3.raw

SEQ ID NO: 464724 - DNA, 509 bp, Homo sapiens
  misc_feature: HEFZJCU01B3DHT.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatccctccgggacagacttaccatgaccacgaactcctccataaacacagcctacatggagttgaggagcctgacatctgacgacacggccgtctattactgtgcgagagtcccacgatccggtgagcctacggcagcggcctttgacttctggggccagggacg

SEQ ID NO: 464725 - DNA, 500 bp, Homo sapiens; identical to SEQ ID NO: 447746
  misc_feature: HEFZJCU01BLSTR.10.71.G05.1.454.heavy.3.raw

SEQ ID NO: 464726 - DNA, 525 bp, Homo sapiens
  misc_feature: HEFZJCU01ETI7J.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggttctacttcgatctcgtggggccgt

SEQ ID NO: 464727 - DNA, 510 bp, Homo sapiens; identical to SEQ ID NO: 445542
  misc_feature: HEFZJCU01DRMRE.16.21.B10.1.454.heavy.3.raw

SEQ ID NO: 464728 - DNA, 511 bp, Homo sapiens; identical to SEQ ID NO: 448280
  misc_feature: HEFZJCU01E1KZT.16.71.G05.1.454.heavy.3.raw

SEQ ID NO: 464729 - DNA, 493 bp, Homo sapiens; identical to SEQ ID NO: 447743
  misc_feature: HEFZJCU01D97WP.19.59.F04.1.454.heavy.3.raw

SEQ ID NO: 464730 - DNA, 509 bp, Homo sapiens
  misc_feature: HEFZJCU01DPJBS.51.56.F01.1.454.heavy.3.raw
cgatcgtatacacgaccggtgctcgatttagcagacgtctgaacacacaaagggggagcatcacccagcaaccacatctgtcctctagagaaccccctgagagccccgctcctcaccatggactggacctggaggatcctcttcttggtggcagcagccacaagagcccaatcccaggtgcaggtggtgcagtctggggctgaggtgaagaagcccggggcctcagcgaaggtctcctgcaagacctctggctacaccttcagtggcaacaacgtccactgggtgcgccaggcccctggacaaggacttgagtggatgggatggtttagtctgagaactggtgccgcaaattatgcacaggagtttcggggcaggggtcgtcatgaccggggacacgtccatcgccacgacttacatggaactgaccagtctgacatttgacgacacggccgtctattactgtgcgacagaagcggcggacagaggttcgcttactggttcgaggctcc

SEQ ID NO: 464731 - DNA, 509 bp, Homo sapiens
  misc_feature: HEFZJCU01D2T3S.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggcttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccg

SEQ ID NO: 464732 - DNA, 509 bp, Homo sapiens
  misc_feature: HEFZJCU01D6VM2.9.12.B01.1.454.heavy.3.raw
  modified_base (477)..(477): a, c, t, g, unknown or other
tgatacgtctcacgaccggtgctcgatttagtagtgtagattccgcgggggctctgggagaggagcccagcactgggattccgaggtgtttccattcagtgatctgcactgaacacagaggactcgccatggagtttgggctgagcgtggtttcgtgtagctatttaaagtgtcagtgtgaggtgcagctggtggagtctgggggaggcttggtccagcctgggggtccctgaaactctcctgttgcagcctctggatacaccgtcagtagtaactccatgaactgggtccgccaggctccagggaaggggctggagtgggtctcagttatttatagcggtggtaacacatactacgcagactccgtgaagggcagattcaccatctccagagacaattccaggaacacgctgtatcttcaaatgaacagcctgagagtcgaggacacggctgtatattactgttgcgagagattgngtacgcttttgatatctggggcccaaggggaa

SEQ ID NO: 464733 - DNA, 534 bp, Homo sapiens
  misc_feature: HEFZJCU01EPOUZ.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggccc

SEQ ID NO: 464734 - DNA, 500 bp, Homo sapiens
  misc_feature: HEFZJCU01BBTW3.22.5.A05.1.454.heavy.3.raw
acatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcagcccccaggaaaggccctagactggcttgcactcatttattggaatgatgataagcgctacagcccatctctgaagagcagactcaacatcaccaaggacacctccaaaaagccaagtggtccttacaatgaccaacatggaccctttggacacagccacatattactgtgcacaccacagggtctctactgctggctttcagtacaactggttcgaaccctggggccagggaaccctggtcagcgtctcctcagcct

SEQ ID NO: 464735 - DNA, 467 bp, Homo sapiens
  misc_feature: HEFZJCU01DTFB3.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaaggccatcggtcttcccctgcgccctgctccagagcacctccgagagcacagcggccctgggctgcctggtcaaggactacttccctacacgtgct

SEQ ID NO: 464736 - DNA, 510 bp, Homo sapiens
  misc_feature: HEFZJCU01CQDCO.53.61.F06.1.454.heavy.3.raw
cgcgtatacacacgaccggtgctcgatttagctacgctctaagggaaagggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcacctagtggagtctgggggaggcgtcgtccaccctggggggtccctgagactctcctgtgcagcctctggattcaccttcagagtctatggcatgcactgggtccgccaggctccaggcaaggggctggagtgggtggcacttatatcagatgatggaagtgatacatactatggagactccgtgaagggccgattcaccatctcgagagacaattccaggaacacgctgtatctgcaaatgaacggcctgagagctgaggacacggctgtgtattacgtgtgcgaaacgggtttgaggtgggaagttaggggtcg

SEQ ID NO: 464737 - DNA, 504 bp, Homo sapiens; identical to SEQ ID NO: 445648
  misc_feature: HEFZJCU01BSHPE.17.25.C03.1.454.heavy.3.raw

SEQ ID NO: 464738 - DNA, 531 bp, Homo sapiens; identical to SEQ ID NO: 446857
  misc_feature: HEFZJCU01CRLFM.7.78.H01.1.454.heavy.3.raw

SEQ ID NO: 464739 - DNA, 522 bp, Homo sapiens
  misc_feature: HEFZJCU01CXXVO.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaagggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggactcaccctgttctacttcgatctctggggccgtc

SEQ ID NO: 464740 - DNA, 507 bp, Homo sapiens
  misc_feature: HEFZJCU01AY2RM.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctggggccagggaaccctggtcaccgtctcctcagcctccaccaagggcccatcggtctcccctggcaccctcctccaagagcacctctggggcacagcggccctgggctgcctggtcaggactacttccgtacta

SEQ ID NO: 464741 - DNA, 511 bp, Homo sapiens
  misc_feature: HEFZJCU01D661M.17.25.C03.1.454.heavy.3.raw
  modified_base (412)..(412): a, c, t, g, unknown or other
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggancctgacatctgacgacacggccgtctattactgtgcgagagtcccacgatccggtgacgcctacggcagcggcctttgacttctggggccaggggaccg

SEQ ID NO: 464742 - DNA, 515 bp, Homo sapiens
  misc_feature: HEFZJCU01DLGK9.10.53.E09.1.454.heavy.3.raw
catagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttcttgcaaatgaacagcctgagagctgaggacacggctgtgtattactgttcgtttggttctgactcgtcgggggaataccttcagcactc

SEQ ID NO: 464743 - DNA, 520 bp, Homo sapiens
  misc_feature: HEFZJCU01DYWPI.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaacagttctccctgaagctgagctctgtgactgccgcggacacggccgtgtattactgtgcgaggtcgattgtgatggtaacaactgcttcttactcctttgaccagtggggccggggaaccctggtcaccgtctcttcagcctccaccaagggcccatcggtcttccctggcaccctcctccaacgagcacctctcgggggcacagcc

SEQ ID NO: 464744 - DNA, 522 bp, Homo sapiens
  misc_feature: HEFZJCU01D4URX.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaaaggccgattcaccatctccagagacacttccgagaacacgctgtatctgcgaatgaacagcctgagagtcgaggacacggccatatattactgtgcgaaagatcctgaggcctataccacctcagtcagctggttcgacccctgggccagggaaccctggtcaccgtctcctcagcctccaccaagggcccatcggtcttcccctggccaccctcctccaagacgcacctcgtgggggcacagcggccctgggctgcctggtcaaggactacttccgagtagtacacg

SEQ ID NO: 464745 - DNA, 481 bp, Homo sapiens
  misc_feature: HEFZJCU01CGC40.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctggcgccctgctccaggagcacctccgagagcacagcggccctgggctgcctggtcaaggactacttccactactat

SEQ ID NO: 464746 - DNA, 500 bp, Homo sapiens
  misc_feature: HEFZJCU01AP3LE.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtcttcccctggcgccctgctccaggagcacctccgagagcacagcggccctgggctgactggtcaaggactacttcctacgtcgtat

SEQ ID NO: 464747 - DNA, 507 bp, Homo sapiens
  misc_feature: HEFZJCU01CI3GD.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtgggttgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaaagtgacgtggtattccggggggacgacatgacaccg

SEQ ID NO: 464748 - DNA, 529 bp, Homo sapiens
  misc_feature: HEFZJCU01EQGIP.13.33.C11.1.454.heavy.3.raw
tcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggagttggggatatctcttatagtgggagtacgaactacaatccgtccctcaagagtcgagtcatcatatccgtagacaggtccaggaacgaattctccctgaaagtgagttctgtgaccgtcgcagacacggctgtctattatttgtgcgagacggcaaaatatggttcaggggtagttcgactacgtggggccaggggaaccctggtcaccgtctcctcagcctccaccaacggg

SEQ ID NO: 464749 - DNA, 534 bp, Homo sapiens
  misc_feature: HEFZJCU01ARRP2.12.12.B01.1.454.heavy.3.raw
atacgacgtacacgaccggtgctcgatttagtagtgtagattccgcgggggctttctgagagtcatggacctcctgtgcaggaacatgaagcacctgtggtttttcctcctgctggtggcagctcccagatggggcctgtcccaggtgcagctgcaggagtcgggcccaggactggtgaagccttcggagaccctgtccctcacctgcgctgtgtccggtttctccatcagtagtgggcattattggggctggatccggcagcccccagggaaggggctggagtggattgggagtatctattttagcgggagcacctaccagaacgcgtccctcaagagtcgaatcaccatgtcggtggacacatcgaagaaccagatctcccttaagttgaggtctgtgaccgccgctgacacggccgtctattactgtgcgagagtccgtgctggaagaactactttttttgactattggggccagggaatcctggtcaccgtcgcctcagcctccaccaagggcccatcggtcttcccccg

SEQ ID NO: 464750 - DNA, 484 bp, Homo sapiens
  misc_feature: HEFZJCU01EAY6F.10.85.H08.1.454.heavy.3.raw
catagtagtgcacgaccggtgctcgatttagtatcactcagtcgggggctgggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctatggttcggacctctggggccagggaaccctggtcaccgtctcatcagcctccaccaaggccatcggtcttcccctggcgccctgcctccaggagcacctccgagagcacagcggccctgggctgcctgtcaaggactactcccactactatg

SEQ ID NO: 464751 - DNA, 506 bp, Homo sapiens
  misc_feature: HEFZJCU01BR0XX.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagccgtacggcagcggcctttgactttcgtc

SEQ ID NO: 464752 - DNA, 523 bp, Homo sapiens
  misc_feature: HEFZJCU01DAOZ1.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaacgggcccatcggtcttcccctggccg

SEQ ID NO: 464753 - DNA, 481 bp, Homo sapiens; identical to SEQ ID NO: 444957
  misc_feature: HEFZJCU01BCLEL.19.67.G01.1.454.heavy.3.raw

SEQ ID NO: 464754 - DNA, 492 bp, Homo sapiens
  misc_feature: HEFZJCU01AWRSI.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtttcctcagcctccaccaagggcccatcggtcttcccctggcgcctgctccaggagcacctccgacgagcacagcggcccgtgggctgcctggtcaaggactacttccgtatctctcg

SEQ ID NO: 464755 - DNA, 390 bp, Homo sapiens; identical to SEQ ID NO: 444541
  misc_feature: HEFZJCU01DIQZ4.16.24.C02.1.454.heavy.3.raw

SEQ ID NO: 464756 - DNA, 502 bp, Homo sapiens; identical to SEQ ID NO: 451203
  misc_feature: HEFZJCU01AD84E.10.38.D05.1.454.heavy.3.raw

SEQ ID NO: 464757 - DNA, 524 bp, Homo sapiens; identical to SEQ ID NO: 446401
  misc_feature: HEFZJCU01B442H.3.82.H05.1.454.heavy.3.raw

SEQ ID NO: 464758 - DNA, 511 bp, Homo sapiens
  misc_feature: HEFZJCU01DYG5A.3.71.G05.1.454.heavy.3.raw
agacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggattttccttttggctattttaaaaggtgtccggtgtgaagtgcaactggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtgataacatcggctatgcggactctgtgaagggccgattcaccatctccagagacaacgccaagaactccctgtatctgcaaatgaacagtctgagacctgaggacacggccttgtattactgtgtaaagtcccgggaaatatgtacggattttggaactt

SEQ ID NO: 464759 - DNA, 520 bp, Homo sapiens
  misc_feature: HEFZJCU01BUNIM.48.4.A04.1.454.heavy.3.raw
agtatacatacacgaccggtgctcgatttagagtagtgatcaggggagtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttctccctgaaactgaccgctgtgaccgccgcggacacggctgtgtattactgtgcgagacgaatgggcgggtggctacgacttgacttttggggccagggaaacctggtcaccgtctcccagcttccaccaacgggcccatcggtcc

SEQ ID NO: 464760 - DNA, 492 bp, Homo sapiens
  misc_feature: HEFZJCU01EM4N1.4.21.B10.1.454.heavy.3.raw
agcactgtagcacgaccggtgctcgatttagtgtcgtcgcaagagagggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaaggcccatcggtcttcccctgcgccctgctccagagcacctccgagagcacagcggccctgggctgcctggtcaaggactacttccctacagtgct

SEQ ID NO: 464761 - DNA, 531 bp, Homo sapiens
  misc_feature: HEFZJCU01BS2LQ.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactggctcggcccctggggcccggaaccctggtcaccgtctcctcagcctccaccaagggcccatccggtcttcccctggccaccctcctcc

SEQ ID NO: 464762 - DNA, 507 bp, Homo sapiens; identical to SEQ ID NO: 444486
  misc_feature: HEFZJCU01BV2YW.4.67.G01.1.454.heavy.3.raw

SEQ ID NO: 464763 - DNA, 508 bp, Homo sapiens
  misc_feature: HEFZJCU01A8KFM.52.42.D09.1.454.heavy.3.raw
cgcagtacgacacgaccggtgctcgatttagacacatacgcagggaaaggggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctgggggggctggtccaggctgggaggtccctgagactctcctgtgcagcctctggattcaccttcagtacccatgaaatgcactgggtccgccaggctccaggcaaggggctggagtgggtgcagttatatcctatgatggaagcaataagcactacgcagagtccgtgaagggccgattgaccatctccagagacaactcgaagatacggttctctacaatgaacagcctgagtagctgaggacacggtctattgttttacgtgttgcggagaggggaactcgtattacgagcacgccctaac

SEQ ID NO: 464764 - DNA, 506 bp, Homo sapiens; identical to SEQ ID NO: 451787
  misc_feature: HEFZJCU01CEVHF.8.38.D05.1.454.heavy.3.raw

SEQ ID NO: 464765 - DNA, 520 bp, Homo sapiens
  misc_feature: HEFZJCU01B2CAY.12.40.D07.1.454.heavy.3.raw
atacgacgtacacgaccggtgctcgatttagtgatagagcgtaacacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttcccctggcg

SEQ ID NO: 464766 - DNA, 505 bp, Homo sapiens
  misc_feature: HEFZJCU01CWORM.13.87.H10.1.454.heavy.3.raw
tcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaaggcctggagtgggtctcaggtattaggttggaatagtggtagcataggctatgcggactctgtgaagggccgattcaccatctccagagacaacgccaagaactccctgtatctgcaaatgaacagcctgagagctgaggacacgggccttgtatttattgtgcaaaagatcccaaccccttacgtt

SEQ ID NO: 464767 - DNA, 518 bp, Homo sapiens
  misc_feature: HEFZJCU01C13T4.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccagggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggcccatcggtcttcccctggcaccctcctccaagagcacctctgggggcacagcggccctggctgcctggtcaaggactacttcctagagacacg

SEQ ID NO: 464768 - DNA, 507 bp, Homo sapiens
  misc_feature: HEFZJCU01CNAFN.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaagggctggagtggctcgcacttatttacagtggcggcactacatactacacagacttcgcgaggggccgattcaccatctccagagacgattccaagaacacgttgtatcttcaatgaacagcctgacagtcgacgacacggccatgtatttttgtgtcgagcgacccggggctcctcaatggctttcattacg

SEQ ID NO: 464769 - DNA, 526 bp, Homo sapiens
  misc_feature: HEFZJCU01D21DX.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtcttccccctcggcgccccgctccaggagcacctccgagagcacagcggccctggg

SEQ ID NO: 464770 - DNA, 506 bp, Homo sapiens; identical to SEQ ID NO: 445682
  misc_feature: HEFZJCU01D34NH.48.44.D11.1.454.heavy.3.raw

SEQ ID NO: 464771 - DNA, 506 bp, Homo sapiens
  misc_feature: HEFZJCU01EPCFR.40.59.F04.1.454.heavy.3.raw
tctagcgactcacgaccggtgctcgatttagtacacacacttagggattgggggtattcagtgatcaggactgaacacacaggactcaccatggagttggggctgagctgggttttccttgttgccatattagaaggtgtccactgtgaggtgcagctggcggagtctgggggagacttggtacagcctggggagtccctgagactctcctgtgcagcctctggattcaccttcagtttgtttgacatgcactgggtccgccaggctccaggaaaaggtctggagtgggtctcagtcatgggtacagctggtcacacatactatgcagactccgtaaagggccgattcaccatctccagagaagacgccaagaattccttgtatcttcagatgaacagtctgagaaccgatgacacggctgtgtattattgtgcaaaaggggggagcagctcgtccatccacttcgactcctggggccagggaaccctggtcaccgtctcctcacg

SEQ ID NO: 464772 - DNA, 501 bp, Homo sapiens
  misc_feature: HEFZJCU01CDDAT.49.35.D02.1.454.heavy.3.raw
agtcgagagacacgaccggtgctcgatttagcacacgatagttgggtttggggacacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttgagtgggtgggaaggatcacccctatccttaatatagcaaactatgcacagacattccacgacagagtcacccttatcgcggacaaatccacgaacacagcctacatggaactgcgcagcctaggatctgccgacacggccgtatatttctgtgcgagagagatgtctttctatgatagtactagtcgattatgcttcg

SEQ ID NO: 464773 - DNA, 379 bp, Homo sapiens; identical to SEQ ID NO: 444450
  misc_feature: HEFZJCU01EGQNW.47.77.G11.1.454.heavy.3.raw

SEQ ID NO: 464774 - DNA, 524 bp, Homo sapiens
  misc_feature: HEFZJCU01DDSJ4.9.78.H01.1.454.heavy.3.raw
  modified_base (485)..(485): a, c, t, g, unknown or other
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagngcacagcggcctgggctgcctggtcaaggactacttcca

SEQ ID NO: 464775 - DNA, 529 bp, Homo sapiens; identical to SEQ ID NO: 446160
  misc_feature: HEFZJCU01AXUXU.17.34.D01.1.454.heavy.3.raw

SEQ ID NO: 464776 - DNA, 506 bp, Homo sapiens; identical to SEQ ID NO: 445864
  misc_feature: HEFZJCU01AZOUS.13.37.D04.1.454.heavy.3.raw

SEQ ID NO: 464777 - DNA, 528 bp, Homo sapiens
  misc_feature: HEFZJCU01B7E05.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaccaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacactccctagaaagcgtacaactactactactacggtatggacctc

SEQ ID NO: 464778 - DNA, 395 bp, Homo sapiens; identical to SEQ ID NO: 444517
  misc_feature: HEFZJCU01E0DAM.16.68.G02.1.454.heavy.3.raw

SEQ ID NO: 464779 - DNA, 519 bp, Homo sapiens
  misc_feature: HEFZJCU01EN9EL.53.27.C05.1.454.heavy.3.raw
cgcgtatacacacgaccggtgctcgatttagacgcgatcgaagggtttgggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttggtccagcctggggggtccctgagactctcctgtgcagcctctggattgaccgtcagtagcaactacatgagctgggtccgccaggccccagggaaggggctggagtgggtctcaacaatttatagcggtggtaggacataccacgcagaccccgtgaagggccgattcaccatctccagacacaattccaagaacacactgtttcttcaaatggacttcctgagaactgaggacacggccgtgtattactgcgcgagagtgcatgatagtggtttccatgtatgcttttgatgtctggggaccg

SEQ ID NO: 464780 - DNA, 526 bp, Homo sapiens
  misc_feature: HEFZJCU01DV532.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggactccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatccggtctttccccctggccg

SEQ ID NO: 464781 - DNA, 489 bp, Homo sapiens
  misc_feature: HEFZJCU01AD2XR.51.52.E08.1.454.heavy.3.raw
cgatcgtatacacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagcctggggcctcagtgaaggtctcctgcaagacttctggatacaccttcaccgactactatatgcactgggtgcgacaggcccctggacaagggcttgagtggatgggatggatcgaccctaagaatggtgccacaaactatgcacagacttttcagggctgggtcaccatgaccagcgacacatctagcaacacagtctacatggagttgaccagcctgaccgacacggccgtgtatttttgtgttgagagattttcggaacaatccagagacccct

SEQ ID NO: 464782 - DNA, 510 bp, Homo sapiens; identical to SEQ ID NO: 456418
  misc_feature: HEFZJCU01EE7QY.12.78.H01.1.454.heavy.3.raw

SEQ ID NO: 464783 - DNA, 506 bp, Homo sapiens; identical to SEQ ID NO: 444696
  misc_feature: HEFZJCU01B7LIB.16.34.D01.1.454.heavy.3.raw

SEQ ID NO: 464784 - DNA, 498 bp, Homo sapiens
  misc_feature: HEFZJCU01BWRSL.51.64.F09.1.454.heavy.3.raw
cgatcgtatacacgaccggtgctcgatttagcgcgtatacaaggggctgggagaggagcccagcactagaagtcggcggtgtttccattcggtgatcagcactgaacacagaggactcaccatggagtttgggctgagctgggtttttcctcgtcgttcttataagaggtgtccagtctgaggcgcagctggtggagtctgggggaggagtggtccagcctgggaggtccttgagactctcctgtgcagcctctggattcaccttcagagtctatggcatgaactgggtccgccaggctccaggcaaggggctggagtgggtggcattcatttcagaggatggaattaagagatactatacagactccgtgaagggccgattcaccatctccagagacaattccaagaactcgctctatctgcaaatgagcagcctgagacctgaggacacggctgtctattactgtgcgaaacggatgaggtgggaactagggttta

SEQ ID NO: 464785 - DNA, 507 bp, Homo sapiens; identical to SEQ ID NO: 445401
  misc_feature: HEFZJCU01EKZ00.22.86.H09.1.454.heavy.3.raw

SEQ ID NO: 464786 - DNA, 436 bp, Homo sapiens; identical to SEQ ID NO: 444686
  misc_feature: HEFZJCU01A7TXG.40.27.C05.1.454.heavy.3.raw

SEQ ID NO: 464787 - DNA, 511 bp, Homo sapiens
  misc_feature: HEFZJCU01BH5O2.40.36.D03.1.454.heavy.3.raw
tctagcgactcacgaccggtgctcgatttagctgcgtcacgatctctcttgggggggagaggagccccagccttggaattcccaagtgttttcattcagtgatcaggactgaacacagaggactcaccatggagtttgggcttgagctggattttccttgctgctattttaaaaggtgtccagtgtgaggtgcagctggtgcagtccgggggggcctggtaccgcctggggggtcccttagactctcctgtgcagcctctggattcatcttcagtaatgtctggatgacctggttccgccaggctccagggaaggggctggagtgggttggccgtgttaaaaccaagctgagggtggacaatagactacgctgcacccgtgacaggcagattcgccatctcaagagatgattcagaaggcacgctgtatctgcaaatgaacagcctgaaagccgaggacacagccgtagtattattgtaccgcagggctcggttactccgtatactgactt

SEQ ID NO: 464788 - DNA, 527 bp, Homo sapiens
  misc_feature: HEFZJCU01EZKYK.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttggggccagggaaccctggtcaccgtctcctcagcctccaccaagggcccatcggtcttcccctggcaccctcctccaagagcacctctggggcacagcggccctgggctg

SEQ ID NO: 464789 - DNA, 392 bp, Homo sapiens
  misc_feature: HEFZJCU01C2VUR.16.70.G04.1.454.heavy.3.raw
tgtactactccacgaccggtgctcgatttagtgtagtgtgaagggaaggggctggagtggatcgggaatatctattatagtgggagcacctactacaacccgtccctcaagagtcgagtcgccatatccgtagacacgtccaagaaccacttctccctgaaactgagctctgtgaccaccgcagacacggctgtctattactgtgcgagacagagttacgacggtggttactccggtctctttgacaactggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 464790 - DNA, 486 bp, Homo sapiens
  misc_feature: HEFZJCU01EBY17.26.78.H01.1.454.heavy.3.raw
  modified_base (426)..(426): a, c, t, g, unknown or other
  modified_base (447)..(447): a, c, t, g, unknown or other
agactatactcacgaccggtgctcgatttagtgtgagtagtttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccaggcctgggaggtccctgagactctcctgtgcagcctctggattcaccttcagttactatactatgcactgggtccgccaggctccaggcaaggggctggagtagggtggcagttatatcatatgatggaagcagcacatattacacagactccgtgaagggccgattcaccatctccagagacaatttgaagaacacgctgtatctgnaaatgaacagcctgagagctnaagacacggctagtgttttactgtgcgagagagatgacg

SEQ ID NO: 464791 - DNA, 482 bp, Homo sapiens; identical to SEQ ID NO: 444503
  misc_feature: HEFZJCU01AF30E.7.10.A10.1.454.heavy.3.raw

SEQ ID NO: 464792 - DNA, 490 bp, Homo sapiens
  misc_feature: HEFZJCU01DDI80.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtgcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagt

SEQ ID NO: 464793 - DNA, 493 bp, Homo sapiens
  misc_feature: HEFZJCU01C2DE3.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttccccctggcgccctcgctccaggagcgacctccgacgagcacagcggccctgggctgcctggtcaaggactacttcccatactcgta

SEQ ID NO: 464794 - DNA, 516 bp, Homo sapiens
  misc_feature: HEFZJCU01ELLLM.12.71.G05.1.454.heavy.3.raw
  modified_base (399)..(399): a, c, t, g, unknown or other
  modified_base (485)..(485): a, c, t, g, unknown or other
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaatacgcacagaggttccagggcagagtcaccattaccgcggacgaggccacgaagacagtctacatggaattgagtagcctgagatttgacgacacggccatgtattactgtgcgagggagggccagctgctgggagcgtctacatatttcgaccctgggccagggaacccnggtcaccgtctcctcagcctccaccaacgggcccatccgtcttccccctggccgccctgcctccaggagccacctccgagagcacncgcgccctggctgcctggtcaggactctcct

SEQ ID NO: 464795 - DNA, 514 bp, Homo sapiens
  misc_feature: HEFZJCU01AEO2E.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccgagggaaggggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagaccgctacgtgggggcccggagcccctggtcc

SEQ ID NO: 464796 - DNA, 419 bp, Homo sapiens; identical to SEQ ID NO: 449838
  misc_feature: HEFZJCU01CM6PU.4.46.E02.1.454.heavy.3.raw

SEQ ID NO: 464797 - DNA, 526 bp, Homo sapiens
  misc_feature: HEFZJCU01DWW7B.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactgggccagggaaccctggtcaccgtctcctcagcctccacc

SEQ ID NO: 464798 - DNA, 531 bp, Homo sapiens
  misc_feature: HEFZJCU01EFKCR.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagtttacgtggactctgtgaagggccgtttcaccatctccagagacaacgccaagaattcactgtatctacaactgaacagcctgagagtcgcagacacggccgtgtattactgtgcgagatgtggaaaaagtatggctgtgtttatggggccagggagcctggtcaccg

SEQ ID NO: 464799 - DNA, 530 bp, Homo sapiens
  misc_feature: HEFZJCU01D3EFA.53.33.C11.1.454.heavy.3.raw
cgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgggagctagaagacacggctgtgtattactgtgcgagtgagatgtcttactatgatgccagttggtttggtaccgttccgacccgtcggggccgacgggaaccctcggtccaccgtcctcctcacgtccttccaaccgaacgggcccatccggtccttccccgtcgggccgcctcg

SEQ ID NO: 464800 - DNA, 383 bp, Homo sapiens; identical to SEQ ID NO: 444477
  misc_feature: HEFZJCU01EDZUB.47.60.F05.1.454.heavy.3.raw

SEQ ID NO: 464801 - DNA, 533 bp, Homo sapiens
  misc_feature: HEFZJCU01EDJU6.17.28.C06.1.454.heavy.3.raw
  modified_base (475)..(475): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattacngtgcgagatgtggaaaaagtatggctgtgtttattggggccagggagcctggtcaccg

SEQ ID NO: 464802 - DNA, 520 bp, Homo sapiens
  misc_feature: HEFZJCU01DLHU1.49.38.D05.1.454.heavy.3.raw
agtcgagagacacgaccggtgctcgatttagtatctgatagttgggtttggggacccaacaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcaacggtcgtcatgggatttgactactggggccaggggaaccccggtcaccgtctcctctgcct

SEQ ID NO: 464803 - DNA, 501 bp, Homo sapiens
  misc_feature: HEFZJCU01C4C2X.40.48.E04.1.454.heavy.3.raw
  modified_base (450)..(450): a, c, t, g, unknown or other
tctagcgactcacgaccggtgctcgatttagagagcgtcacagagagaaggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgttgcagtcggggggaggcttggtacagcctgggggtccctgagactctcctgtgcagcctctggattcacctttacctcctattccatgagctgggtgcgccaggctccagggcagggcctggagtgggtctcaggcattagtagtaatggtgctgccacattctacgcagactccgtgaagggccggttcaccatctccagagacaattccaaagaacacggtacatctgcaaatgaacagcctgacngccgagacacggccgtttattacgtgtacgaaggatccgtccctgtctcgg

SEQ ID NO: 464804 - DNA, 511 bp, Homo sapiens
  misc_feature: HEFZJCU01EZOJO.9.64.F09.1.454.heavy.3.raw
tgatacgtctcacgaccggtgctcgatttagcgcgtatacaaggggctcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagcctggggggtccctgagactctcctgtgcagcctctggattcacctttagtcactattggatgagttgggtccgccaggctccagggaagggcctggagtgggtggccaacataaaggaagatggaagtgagaagtcctatgtggactctgtgaagggccgattcatcatctccagagacaacgccgagaactccctgtatctgcaaatgaacagcctgagagtcgaggacacggctatgtattattgtgtgagagaataaaagtggggccgacgggaaccctggtcaccgtct

SEQ ID NO: 464805 - DNA, 507 bp, Homo sapiens
  misc_feature: HEFZJCU01DC75G.19.17.B06.1.454.heavy.3.raw
tactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttccttgttgctattttagaaggtgtctctctatttgcaagtgtccagtgtgaagtgcagctggtggagtctgggggaggcctggtcaagcctggggggtccctgcgactctcctgtgtggtctccggattcccattcagtcactatagtatgatgtgggcccgccaggctccgggaagggctggaatggcttgcatcccttggttggagtggaattaatacacaccacgcagactcagtgaggggccggttcaccatctccagagacaacgccaagagtacaatgtatttacaaatgaacagcctgagagccgaggatacggctgtgtattattgtgcgagaatttccgagccgcactta

SEQ ID NO: 464806 - DNA, 499 bp, Homo sapiens
  misc_feature: HEFZJCU01A3VMI.11.73.G07.1.454.heavy.3.raw
cgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggaggcttggtacagcctggacggtccctgagactctcctgtgcagcctctggatacatcttcaaagtttcgaaatgagctgggtccgccaggctcctgggaaggggccggagtggatttcatacatcagtagtagtggtaacaccttgtactatgcagactctgtgaagggccgattcaccatctccagagacaacgccaagaattcactgtttctgcaaatgaacagcctgagagacgaggatacggctatttactattgtgcgcgatcgacagaaaaagcggtggcctattc

SEQ ID NO: 464807 - DNA, 517 bp, Homo sapiens; identical to SEQ ID NO: 445913
  misc_feature: HEFZJCU01A6RRP.7.78.H01.1.454.heavy.3.raw

SEQ ID NO: 464808 - DNA, 530 bp, Homo sapiens
  misc_feature: HEFZJCU01BFVEP.48.4.A04.1.454.heavy.3.raw
agtatacatacacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttctccctgaaactgaccgctgtgaccgccgcggacacggctgtgtattactgtgcgagacgaatgggcgggtggctacgacttgacttttggggccgagggaaacctggtcaccgtctccccacgcttccaccaacgggcccatcggtccttcccccg

SEQ ID NO: 464809 - DNA, 513 bp, Homo sapiens
  misc_feature: HEFZJCU01AIWCE.13.9.A09.1.454.heavy.3.raw
tcacgtactacacgaccggtgctcgatttagcgagacgcgcagggggggagaggagccccagccgtgagattcccaggagtttccacttggtgatcagcactgaacacagaccaccaaccatggagtttgggcttacttgggttttccttgttgctattttaaaaggtgtccaatgtgagctgcagctggtggagtctgggggaggtttggtacagccagggcggtccctgagactctcctgtataacttctggattcaacttgggtgattatgctatgaactgggtccgccaggctccagggaaggggctggagtgggtaggtttcattaggagcaattctcatgatgggacaacagaatacgccgcgtctgtaaaaggcagattcaccatctcaagagatgagtccagaagcatcgcctttctgcagatgagtagcctgaagaccgaggacacagccatctattactgtgctagagagtattgcagtcctacgacctgctatgggggtccg

SEQ ID NO: 464810 - DNA, 510 bp, Homo sapiens
  misc_feature: HEFZJCU01ERA92.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctccaagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttagttttaggaccagctagttaaaactcctactacggtctggacgtcgtggggcc

SEQ ID NO: 464811 - DNA, 508 bp, Homo sapiens
  misc_feature: HEFZJCU01D19YR.51.56.F01.1.454.heavy.3.raw
cgatcgtatacacgaccggtgctcgatttagcagacgtctgaacacacaaagggggagcatcacccagcaaccacatctgtcctctagagaaccccctgagagccccgctcctcaccatggactggacctggaggatcctcttcttggtggcagcagccacaagagcccaatcccaggtgcaggtggtgcagtctggggctgaggtgaagaagcccggggcctcagcgaaggtctcctgcaagacctctggctacaccttcagtggcaacaacgtccactgggtgcgccaggcccctggacaaggacttgagtggatgggatggtttagtctgagaactggtgccgcaaattatgcacaggagtttcggggcaggggtcgtcatgaccggggacacgtccatcgccacgacttacactggaactgaccagtctgacatttgacgacacggccgtctattactgtgcgacagaagcggcgacagaggttcgcttactggttcgagggct

SEQ ID NO: 464812 - DNA, 508 bp, Homo sapiens; identical to SEQ ID NO: 461612
  misc_feature: HEFZJCU01CWVCM.51.56.F01.1.454.heavy.3.raw

SEQ ID NO: 464813 - DNA, 541 bp, Homo sapiens
  misc_feature: HEFZJCU01BF0RZ.8.25.C03.1.454.heavy.3.raw
ctcgcgtgtccacgaccggtgctcgatttagtagtgtagatttgggtttggggggagaggagccccagccgtgagattcccaggagtttccacttggtgatcagcactgaacacagaccaccaaccatggagtttgggcttacctgggttttccttgttgctattttaaaaggtgtccagtgtgaggtgcagctggtggactctgggggaggcttggtacagccagggcggtccctgagactctcctgtacagggactggattcatctttggtgactatgctgtgacctgggtccgccaggctccagggaaggggctggagtgggtaagtctcattagaagtaaagcttatggtgggacaacagattacgccgcgtctgtgaaaggcagattcaccatctcaagagatgattccaaaagcatcgcctttctacaaatggacagcctgaaaaccgaggacacaggcgtgtattactgcaacaggttttggttcgggaaatccgcaaaatgacctctgggccagggaaccctggtcaccgtct

SEQ ID NO: 464814 - DNA, 490 bp, Homo sapiens
  misc_feature: HEFZJCU01AYJJJ.47.85.H08.1.454.heavy.3.raw
  modified_base (427)..(427): a, c, t, g, unknown or other
agctcacgtacacgaccggtgctcgatttagtatcactcagtcggggggaggcgtggtccagccgtgggacgtccctgagactctcctgtgcagcctctggcttcaccttcaataattatgctatgcagtgggtccgccaggctccaggcaaggggctagagtgggtggcggtcatatcgtccagtggacatcttcagtattaccgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccnggagcacctccgagagcacagcggcctgggctgcctggtcaaggactacttcctacgtgagct

SEQ ID NO: 464815 - DNA, 508 bp, Homo sapiens
  misc_feature: HEFZJCU01C56HY.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaaagtgacgtggtagttccggggggacacatgactaccg

SEQ ID NO: 464816 - DNA, 509 bp, Homo sapiens
  misc_feature: HEFZJCU01BHRZW.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggtttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacgagtggcagctccaagtacttac

SEQ ID NO: 464817 - DNA, 504 bp, Homo sapiens
  misc_feature: HEFZJCU01DPRGP.3.20.B09.1.454.heavy.3.raw
  modified_base (485)..(485): a, c, t, g, unknown or other
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactgggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatntctggggccaagggacaat

SEQ ID NO: 464818 - DNA, 481 bp, Homo sapiens; identical to SEQ ID NO: 448685
  misc_feature: HEFZJCU01DS3JQ.7.10.A10.1.454.heavy.3.raw

SEQ ID NO: 464819 - DNA, 527 bp, Homo sapiens
  misc_feature: HEFZJCU01CPBWW.51.30.C08.1.454.heavy.3.raw
cgatcgtatacacgaccggtgctcgatttagtctgacgtcaaagggaaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcactgtctctggtggctccatcagcagcagtagttacttctggggctggatccgccagcccccagggaagggactggagtggatagggaatgtccattatagtgggagcacctactacaatccgtccctcaacagtcgagtcaccatatccgttgacacgtccaagaaccaattcttcctgaggctgacctctgtgaccgccgcagatacggcagtttattactgtgcaagaaagaactaccttgaaactggggaccacggaaccctggtcaccgtctccctcacgcctccaccaagggcccatcggtcttcccccg

SEQ ID NO: 464820 - DNA, 503 bp, Homo sapiens
  misc_feature: HEFZJCU01C2T8G.51.86.H09.1.454.heavy.3.raw
cgatcgtatacacgaccggtgctcgatttagtgctatagacttgggtttgggctatagacttgggtttggggggaagaggaagactgacggtcctcccaggtgtccagtgtcaggtgcagctggtggactctggggggaggcgtggtccagcctgggaggtccctgagactctcctgtgcagcctctggattcaccttcaatacttatggcatgcactgggtccgccaggctccaggcaaggggctggagtggctgtcctttatctcatatgatggaggcaataaaattatgcagactccgtgaagggccgattcaccatctccagagacaattccaagaacactctatatttgcagatgaatagcctgagaattgaggacacggctgtgtattactgtgtgagagggtcggcatattccggtttttggagtaattatctactgggaacttttgatatctggggccacgggacaatggtcaccggtctcttcagtcttccacc

SEQ ID NO: 464821 - DNA, 500 bp, Homo sapiens; identical to SEQ ID NO: 446033
  misc_feature: HEFZJCU01A5JO9.11.27.C05.1.454.heavy.3.raw

SEQ ID NO: 464822 - DNA, 510 bp, Homo sapiens
  misc_feature: HEFZJCU01C5G9S.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaatgaacagcctgagagccgacgacacggccatatattactgtgcgaaagcaccggcagttagtcacccatactactttgactactggggccg

SEQ ID NO: 464823 - DNA, 491 bp, Homo sapiens
  misc_feature: HEFZJCU01APG31.11.38.D05.1.454.heavy.3.raw
cgagagataccacgaccggtgctcgatttagtatctgatagttgggtctgggggaggcttggtacagcctggggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagtggtggtagctgctactggggccagggaaccctggtcaccgtctcctcagcctccaccaagggcccatcggtcttcccctggccaccctcctccaagagcacctctgggggcacagcggcctgggctgcctggtcaaggactacttccgtatctctcg

SEQ ID NO: 464824 - DNA, 464 bp, Homo sapiens; identical to SEQ ID NO: 445062
  misc_feature: HEFZJCU01EI2NB.19.10.A10.1.454.heavy.3.raw

SEQ ID NO: 464825 - DNA, 531 bp, Homo sapiens
  misc_feature: HEFZJCU01BLO4X.53.10.A10.1.454.heavy.3.raw
cgcgtatacacacgaccggtgctcgatttagcgtcgatctcaggggtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgccctccaggggggacctttgggggtttcgacccctggggcccaggggaaccctggtcaccgtctcctcagcctccaccaagggcccatcggtcttccccctggccaccctcctccaagagcacctcg

SEQ ID NO: 464826 - DNA, 397 bp, Homo sapiens
  misc_feature: HEFZJCU01B7IJ1.18.31.C09.1.454.heavy.3.raw
tacgagtatgcacgaccggtgctcgatttagacgtctcatcaaggaaggaaggggctggagtggatttcatacattagtagtgctggcaataccatcctctacgcagactctgtgaagggccggtttcagcgtctccagggacaacgccaataactttctgtttctgcaaatgaacagcctgagagccgaggactcggccacatattactgtgcgagaggaattttgactggttattcctactactttgactactggggccagggcactccggtcaccgtctcctcagcctccaccaagggcccatcggtcttccccctggcaccctcctccaagagcacctctgggggcacagcggccctgggctgcctggtcaaggactacttcccatactcgta

SEQ ID NO: 464827 - DNA, 522 bp, Homo sapiens
  misc_feature: HEFZJCU01CP6M4.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagcctccaggcaagggattggagtggggtggcagtttgtttcatctgagggcagtgttcaatggtatgcagactccgtgaagggccgattcaccatctccagagacaattccaggaacacaatgtatttggaaatgaacagcctaagtcctagaggacacgggtgtatactactgtacgaaggaggggggaaccaggcgggagttcaagtacttccg

SEQ ID NO: 464828 - DNA, 490 bp, Homo sapiens; identical to SEQ ID NO: 448082
  misc_feature: HEFZJCU01BFNJB.47.85.H08.1.454.heavy.3.raw

SEQ ID NO: 464829 - DNA, 504 bp, Homo sapiens
  misc_feature: HEFZJCU01DYFXD.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctcggcaccctcctccaagagcacctctgggggcacagcggccctgggctgcctggtcaaggactacttccgagtagtaca

SEQ ID NO: 464830 - DNA, 509 bp, Homo sapiens
  misc_feature: HEFZJCU01CFWI0.12.27.C05.1.454.heavy.3.raw
atacgacgtacacgaccggtgctcgatttagacgcgatcgaagggtttggggtctgagagaggagcccagccctgggattttcaggtgttttcatttggtgatcaggactgaacagagagaactcaccatggagtttgggctgagctggctttttcttgtggctattttaaaaggtgtccagtgtgaggtgcaactggtggagtctgggggaggcttggtacagccgggggggtccctgagactctcctgtgcaggctctggattcatctttaacaactatgccatgagctgggtccgccaggctccagggaaggggctggagtgggtctcagctattagtaatagtggtgatagcacgatcctacgcagactccgtgaagggccgcttcaccatctccagagacaattccaagaacacgctgtatctccaaatgaacagtctcagagccgaggacacggccatatattactgtgcgaaagacacagccgcatttgggggagtcatcgt

SEQ ID NO: 464831 - DNA, 508 bp, Homo sapiens; identical to SEQ ID NO: 458405
  misc_feature: HEFZJCU01BBYVP.22.86.H09.1.454.heavy.3.raw

SEQ ID NO: 464832 - DNA, 487 bp, Homo sapiens; identical to SEQ ID NO: 448944
  misc_feature: HEFZJCU01CTWGM.53.56.F01.1.454.heavy.3.raw

SEQ ID NO: 464833 - DNA, 541 bp, Homo sapiens
  misc_feature: HEFZJCU01BV2KQ.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggctttttcttgtggctttttaaaaggtgcccagtgtgaggtgcaactgttggagtctggggaggcttggtacagccggggggtccctgagactctcctgtgcagcctctggattcaatttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattactgtgcgaaggatcgcccctataatggtggctggatcggggagtttggttcctggggtccaggggaaccctggtccg

SEQ ID NO: 464834 - DNA, 484 bp, Homo sapiens
  misc_feature: HEFZJCU01EUA4I.47.59.F04.1.454.heavy.3.raw
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcgactcagcctccaccaagggcccatcggtcttccccctggcgccctgctccaggagcacctccgagagcacagccggccctgggctgcctggtcaaggactacttcctacgtgagct

SEQ ID NO: 464835 - DNA, 490 bp, Homo sapiens; identical to SEQ ID NO: 463995
  misc_feature: HEFZJCU01CKLPG.40.81.H04.1.454.heavy.3.raw

SEQ ID NO: 464836 - DNA, 532 bp, Homo sapiens
  misc_feature: HEFZJCU01A5KD7.21.78.H01.1.454.heavy.3.raw
tcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctggggccggggaacccgtcggtcaccgtctccccaccctccaccaac

SEQ ID NO: 464837 - DNA, 327 bp, Homo sapiens; identical to SEQ ID NO: 444439
  misc_feature: HEFZJCU01C135U.40.20.B09.1.454.heavy.3.raw

SEQ ID NO: 464838 - DNA, 512 bp, Homo sapiens
  misc_feature: HEFZJCU01A3AVS.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaagggacaatggtcaccgtctcttcagcctccaccaaggcccatcggtcttcccctggcaccctcctccaagagcacctctggggcacagcgcccg

SEQ ID NO: 464839 - DNA, 467 bp, Homo sapiens
  misc_feature: HEFZJCU01E1LK2.52.8.A08.1.454.heavy.3.raw
cgcagtacgacacgaccggtgctcgatttagcatactctacaggggctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggcggcagttatatcatatgatggaagcaagatatactatgtagactccgtgaagggccgattcatcatctccagagacaactccgagaacacgctgtatctgcaatgaacaggctgagagctgaagacacggctgtatattactgtgc

SEQ ID NO: 464840 - DNA, 511 bp, Homo sapiens; identical to SEQ ID NO: 445840
  misc_feature: HEFZJCU01AKHJI.11.13.B02.1.454.heavy.3.raw

SEQ ID NO: 464841 - DNA, 397 bp, Homo sapiens
  misc_feature: HEFZJCU01DHFIB.47.46.E02.1.454.heavy.3.raw
agctcacgtacacgaccggtgctcgatttagactcatctacaggggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 464842 - DNA, 496 bp, Homo sapiens
  misc_feature: HEFZJCU01CNGP9.48.59.F04.1.454.heavy.3.raw
agtatacatacacgaccggtgctcgatttagtacacacacttagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtgggccaagggacaagt

SEQ ID NO: 464843 - DNA, 500 bp, Homo sapiens
  misc_feature: HEFZJCU01BX2M2.51.43.D10.1.454.heavy.3.raw
cgatcgtatacacgaccggtgctcgatttagactagcagtaagggggagcatcacccagcaaccacatctgtcctctagagaatcccctgagagctccgttcctcaccatggactggacctggaggatcctcttcttggtggcagcagccacaggagcccactcccaggtgcagctggtgcagtccgggggtgaagtgaagaagcctggggcctcagtgaaggtctcctgcagggcctctggatacaccttcaccggctattatatccactgggtgcgacaggcccctggacaagggcttgagtggatgggatggatgaagcccaatagtggtgccacaaagacagcacagaagtttcagggcagggtcaccatgaccagggagacgtccgtcaggacagcctatatggaggtgaccagcctgagccctgacgacacggccatatatttctgtgcgcgaggaattcgacttctggataattacttgggttgaactacctt

SEQ ID NO: 464844 - DNA, 541 bp, Homo sapiens
  misc_feature: HEFZJCU01EK46Z.51.49.E05.1.454.heavy.3.raw
cgatcgtatacacgaccggtgctcgatttagagcgactagcaacacacaaaggggggttttctgagagtcatggacctcctggacaagaacatgaaacccctgtggttcttcctcctcctggtggcagctcccagatgggtcctgtcccaggtgcaactgcagcagaggggcgcaagactgttgaagcctttggagaccctgtccctcacctgcactctttctggtgcgactttcagtggttatttctgggctgggtccgccagcccccgggaagggacttcagtggattggggaaatcagtcgtagtggagagaccttctacaacccgtccctcaagagtcgagtcgccatatcaacagacgcgtccaagagtgaggtgtccctgacactcaggtctgtgaccgccgcggacgcggctgtatactactgtgcgagagtccccgctgggttttggagtggttattatgccggtatggacgtcgtggggcgcagggaccacgggtcgccgtctcgtttcagcctccaccaagggccccatcc

SEQ ID NO: 464845 - DNA, 517 bp, Homo sapiens
  misc_feature: HEFZJCU01D42NK.17.37.D04.1.454.heavy.3.raw
cgtagactagcacgaccggtgctcgatttagtagcatactgttgggtttgggggagccccagccctgggattcccagctgtttctgcttgctgatcaggactgcacacagagaactcaccatggagtttgggctgagctgggttttccttgttgctattttaaaaggtgtccagtgtgcggtgcagctggtggagtccgggggaggtttagttcagcctggggggtccctgagactctcctgtgcggcctctggattcaccttcagtagctactggatgcactgggtccgccaagctccagggaaggggctggtgtggggtctcacgtattgatactgatggcattaccacatcctacgcggactccgtgcagggccgattcaccatctccagagacaacgccaagaacacgctgtatctgcaaatgaacagtctgagagccgaggacacggctgtgtactactgtgcaagagtttccccggcagctcgcccggtaacttctggggccagggaaccc

SEQ ID NO: 464846 - DNA, 508 bp, Homo sapiens
  misc_feature: HEFZJCU01BDW89.53.41.D08.1.454.heavy.3.raw
cgcgtatacacacgaccggtgctcgatttagtcacgcgagaaagggaaagggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcacctagtggagtctgggggaggcgtcgtccaccctggggggtccctgagactctcctgtgcagcctctggattcaccttcagagtctatggcatgcactgggtccgccaggctccaggcaagggggctggagtgggtggcacttatatcagatgatggaagtgatacatactatggagactccgtgaagggccgattcaccatctcgagagacaattccaggaacacgctgtatctgcaaatgaacggcctgagagctgaggacacggctgtgtattactgtgcgaacggtttgagtgggaagttaggggtcg

SEQ ID NO: 464847 - DNA, 510 bp, Homo sapiens; identical to SEQ ID NO: 448445
  misc_feature: HEFZJCU01DTMU7.16.71.G05.1.454.heavy.3.raw

SEQ ID NO: 464848 - DNA, 519 bp, Homo sapiens; identical to SEQ ID NO: 446650
  misc_feature: HEFZJCU01AJOQE.13.76.G10.1.454.heavy.3.raw

SEQ ID NO: 464849 - DNA, 503 bp, Homo sapiens
  misc_feature: HEFZJCU01EJU44.40.65.F10.1.454.heavy.3.raw
tctagcgactcacgaccggtgctcgatttagctacgctctaagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtgggccgaagggacaatggtcaccgtctcttc

SEQ ID NO: 464850 - DNA, 546 bp, Homo sapiens
  misc_feature: HEFZJCU01C2P0N.13.40.D07.1.454.heavy.3.raw
tcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccaggggggggcctggagtggcttggaagcatctctcaaagcgggacgaccgactataacccgtcttttaggagtcgagtctcgatttcaatagacaggtctaagacacaattctccctgagggtgacctctatgtcggccgcggacgcggccgtctattactgtgcgcgaggatctccgtcggaacacttcgtgacaaggcaaaacgtccgaagtcgttatcactttgactcctggggccagggaaccctggtcagcgtctcttcagcctcaccaacgggcccatcggtcttccccctggcctaccctcccttccaacgagcacctcctggggggcacgagcggccctggggctgg

SEQ ID NO: 464851 - DNA, 523 bp, Homo sapiens
  misc_feature: HEFZJCU01CHFVL.13.75.G09.1.454.heavy.3.raw
tcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgccggacacggctgtgtattactgtgcgagaggccccgaaaggaggaaagtggctacgatttgggaagtactactacatggacgtctggggcaaagggaccacggtcaccgtcctcctcagt

SEQ ID NO: 464852 - DNA, 518 bp, Homo sapiens
  misc_feature: HEFZJCU01BJPOH.12.58.F03.1.454.heavy.3.raw
atacgacgtacacgaccggtgctcgatttagtctgatcgagaagggaaaggggcagagaggagccttagccctggactccaaggcctttccacttggtgatcagcactgagcacagaggactcaccatggaattggggctgagctgggttttccttgttgctattttagaaggtgtccagtgtgagggacaattggtggagtctgggggaggcttggtccagccgggggggtccctgagactctcctgtacagcctctggattcactctcggaaacttttggatggtctgggtccgccaggctccagggaagggctggagtgggtggccaatatacagtcaggtggaggtacgatacactatctcgactctgtgaagggccggttcaccatctccagagacaacgccaagaattcactgtatctgcaaatgaacagcctgagagtcgaagacacgggtatttatattgtgtgcgagatctggatttccttcgaaatgaagtgtggttcgatgtgtttg

SEQ ID NO: 464853 - DNA, 518 bp, Homo sapiens; identical to SEQ ID NO: 448237
  misc_feature: HEFZJCU01AUN5E.9.70.G04.1.454.heavy.3.raw

SEQ ID NO: 464854 - DNA, 528 bp, Homo sapiens
  misc_feature: HEFZJCU01DRXXB.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctgacaatcacctctccctgaggctgagctctgtgacagccgcggacacgggcgtttattactgtgcgagagggacggactacggtgactactggggggttcgaccccgtggggccaggggaaccctggtcaccgtctcctcacgcctcccg

SEQ ID NO: 464855 - DNA, 510 bp, Homo sapiens
  misc_feature: HEFZJCU01CX2HZ.15.67.G01.1.454.heavy.3.raw
  modified_base (472)..(472): a, c, t, g, unknown or other
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagtttattggatgacctgggtccgccaggctccagggaagggctggagtgggtggccaacataaacaagacggaagtcagaaaaactatgtggactctgtgaacggccgattcaccatctccagagacaacgccaagaattcactgtatttgcaaatgaacagcctgagaggcgaggacacggccgtgtattattntgcgcgagatgatagtagactctacagtgcaggtggta

SEQ ID NO: 464856 - DNA, 504 bp, Homo sapiens
  misc_feature: HEFZJCU01BX80L.10.12.B01.1.454.heavy.3.raw
catagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatctgggggaggcgtggtccagccagggaggtccctgagactctcctgtgcagcctctggattgaggttcaataactatgctatgcactgggtccgccaggctccagggaaggggctggaatggatgacagttatttcacacgatgcaaccaaaacatactacgcggagttcgtgagggcgctgcatcgtctccagagacaattcgaagaacactctgtacctgcaaatgaacagtctgagagccgaggacacggccgtctacttttgtgcgactagaagtgggagctagtaggggatttg

SEQ ID NO: 464857 - DNA, 516 bp, Homo sapiens
  misc_feature: HEFZJCU01EAYLY.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactgggccagggactctggtcaccgtctccgcagccctccaccaacggccactcg

SEQ ID NO: 464858 - DNA, 484 bp, Homo sapiens; identical to SEQ ID NO: 446564
  misc_feature: HEFZJCU01AQABA.19.13.B02.1.454.heavy.3.raw

SEQ ID NO: 464859 - DNA, 392 bp, Homo sapiens
  misc_feature: HEFZJCU01B5AHR.4.45.E01.1.454.heavy.3.raw
agcactgtagcacgaccggtgctcgatttagtgagtcagtaagggaaagggactggaatatattgggtatatctattatggtgggaacaccaactacaacccctccctcaagaatcgagtctcgttttccatggacgcgtccaaaatcagttctctctgaagttgaggtcggtgaccgctgccgacacggccctctattactgtgcgagagacagcagtcttggctatgtgggccctcactttgactcctggggccagggaaccctggtcaccgtctcctcagcctccaccaagggcccatcggtcttccccctggcaccctcctccaagagcacctctgggggcacagcggccctgggctgcctggtcaaggactacttccctacagtgct

SEQ ID NO: 464860 - DNA, 512 bp, Homo sapiens
  misc_feature: HEFZJCU01BF9TL.11.13.B02.1.454.heavy.3.raw
cgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctggg

SEQ ID NO: 464861 - DNA, 487 bp, Homo sapiens
  misc_feature: HEFZJCU01BQT25.10.84.H07.1.454.heavy.3.raw
catagtagtgcacgaccggtgctcgatttagcagacgtctgtcgcgggaggagcatcacccagcaaccacatctgtcctctcgagaatcccctgagagctccgttcctcaccatggactggacctggaggatcctcttcttggtggcagcagccacaggagcccactcccaggtgcacctggtgcagtcggggactgcagtgaggacgcctggggcctcagtgaaggtctcctgcaaggcttctggatacaccttcaccagcttctatatacactgggtgcgacaggcccctggacaaggacttgagtggatgggctggatcaaccctggaagcggtggcacaaattatgcacagagctttcagggcagggtcaccgtgaccagggacacgtccatcgacacagcctacatggacctgagcagtctgaagtctgacgacacggccgtctattactgtgcgagggcgggaggaccttatcagtggtaa

SEQ ID NO: 464862 - DNA, 526 bp, Homo sapiens
  misc_feature: HEFZJCU01EAMIQ.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggccgccctgcctccaggagcacctccgagagcacagcggcctgggctgcctggtcaaggactacttcca

SEQ ID NO: 464863 - DNA, 501 bp, Homo sapiens
  misc_feature: HEFZJCU01AXAEA.13.33.C11.1.454.heavy.3.raw
tcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcataagaattgcaacgatgcttttgatatgtgggccaagggactacg

SEQ ID NO: 464864 - DNA, 511 bp, Homo sapiens
  misc_feature: HEFZJCU01ERSQY.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggtgaactactgggccagggcaccctggtcaccgtctcctcagcttccaccaagggcccatcggtcttcccctggcgccctgctccaggagcacctctgggggcacgagcggccctgggctgcctggtcaaggactacttcccatac

SEQ ID NO: 464865 - DNA, 411 bp, Homo sapiens; identical to SEQ ID NO: 445580
  misc_feature: HEFZJCU01A2I85.51.31.C09.1.454.heavy.3.raw

SEQ ID NO: 464866 - DNA, 490 bp, Homo sapiens
  misc_feature: HEFZJCU01B3SXO.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaagggctggaatgggtctcatctattagtgctactactggtggcacatacttcgcagactccgtgaagggccggttctccatctccagagacaattccaagaacacgctgtatctgcaattgaacagcctgagagccgaggacacggccgtatattactgtgcgaagatttggggaatgaccactc

SEQ ID NO: 464867 - DNA, 481 bp, Homo sapiens
  misc_feature: HEFZJCU01D83W0.47.59.F04.1.454.heavy.3.raw
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggcccatcggtcttcccctggcgccctgctcaggagcacctccgagagcacagcggccctgggctgcctggtcaaggactacttcctacgtgagct

SEQ ID NO: 464868 - DNA, 486 bp, Homo sapiens
  misc_feature: HEFZJCU01ED35P.9.76.G10.1.454.heavy.3.raw
tgatacgtctcacgaccggtgctcgatttagtcactcatacaggggggagaggagcccagcactagaagtcggcggtgtttccattcggtgatcagcactgaacacaaaggactcaccatggagtttgggctgaactgggttttcctcgttgctcttttaagaggtgtccagtgtcaggtgcagctggtggagtctgggggaggcgtggtccagcctgggaagtccctgagactctcctgtgcagcctctggattcaccttcagtaaccatggcctgcactgggtccgccaggctccaggcaggggactggagtgggtggcacttatatcatatgatggaattaaaaatactatgcagactccgtgaagggccgattcaccatctccagagacaactccaagaacacgctgtttctgcaaatgaacagcctgagagctgaggacacggctgtgtatttctgtgctcaagataggtggacttcgatt

SEQ ID NO: 464869 - DNA, 490 bp, Homo sapiens
  misc_feature: HEFZJCU01BWSL1.4.57.F02.1.454.heavy.3.raw
agcactgtagcacgaccggtgctcgatttagctcgatatagttgggttggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctgctccaggagcacctctgggggcacagcggccctgggctgcctggtcaaggctacttccctacagtgct

SEQ ID NO: 464870 - DNA, 539 bp, Homo sapiens
  misc_feature: HEFZJCU01C3OZM.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccaggggaagggcctgggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcagtttacttgaccccttgggggcccggggaaccctggtccaccgtctccccacccctccaacccg

SEQ ID NO: 464871 - DNA, 500 bp, Homo sapiens
  misc_feature: HEFZJCU01CD8IY.3.20.B09.1.454.heavy.3.raw
  modified_base (449)..(449): a, c, t, g, unknown or other
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgnaacagactacggtggcaacgtccatgcttttgatatctggggccaagggac

SEQ ID NO: 464872 - DNA, 510 bp, Homo sapiens; identical to SEQ ID NO: 454674
  misc_feature: HEFZJCU01DGU2I.7.28.C06.1.454.heavy.3.raw

SEQ ID NO: 464873 - DNA, 511 bp, Homo sapiens
  misc_feature: HEFZJCU01BXX26.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagacgtcccacgatccgggtgacgcctacggcaggccggtcctttgactttcgtc

SEQ ID NO: 464874 - DNA, 509 bp, Homo sapiens
  misc_feature: HEFZJCU01A1PRV.11.6.A06.1.454.heavy.3.raw
cgagagataccacgaccggtgctcgatttagatctactgacagggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtctgggggaggcttggtaaagccgggggggtcccttagactctcctgtgcagcctctggcatcactttcagtgacgcctggatgagctgggtccgccaggctccagggaaggggctggagtgggttggccgtattaaaagcgaggctgctggtgggacaacagactacgctgcacccgtgaagggcagattcaccatctccagagatgattcaaggagcacagtgtttctacaaatgaacagcctgactggccggggacactgccgtgtattactgtgccagcagcagcacctggccactatattttctttacg

SEQ ID NO: 464875 - DNA, 492 bp, Homo sapiens
  misc_feature: HEFZJCU01ECI30.14.71.G05.1.454.heavy.3.raw
cgtctagtaccacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatctgggggaggcgtggtccagcctggggaatccctgacactgtcttgtgtagcctctggattcagcttcagaacctatggcatgcactgggtccgccaggccccaggcaaggggctggagtggctgactcttttatcatatgatggaagtcaaaaattctatgcagactccgtgaagggccgattcaccgtctccagggacaactccaagaacaccttatatctgcagatgaacagcctgagaggtgacgactcggctgtatacttctgtgcgacaaacatgatgtttggagtggatgtgta

SEQ ID NO: 464876 - DNA, 524 bp, Homo sapiens
  misc_feature: HEFZJCU01EXJ70.40.67.G01.1.454.heavy.3.raw
tctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattcttatgggcgctcccactacagtgcggccctccagagtcgagccctcatatccatagacacgtccaagaaccagtttccctgacgctgacgtctgtgaccgccgcagacacggctgtctattattgtgcgagactagccttctgtagtgggggtacgttgcaacccgggatactactccaccttcgcgttggacatcgtggggccggaggggcctc

SEQ ID NO: 464877 - DNA, 407 bp, Homo sapiens
  misc_feature: HEFZJCU01CMQX2.3.41.D08.1.454.heavy.3.raw
agacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactcccgggatcttgactactggggccaggggaccctggtcaccgtctcctcagcttccaccaagggcccatcggtcttccccctggcaccctcctccaagagcacctctgggggcacagcggccctgggctgcctggtcaaggactactccgagtgcgtct

SEQ ID NO: 464878 - DNA, 530 bp, Homo sapiens
  misc_feature: HEFZJCU01EZZ2L.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactacgtgggggttcgaccccgtggggccaggggaaccctggtcaccgtctcctcacgcctccaccg

SEQ ID NO: 464879 - DNA, 532 bp, Homo sapiens
  misc_feature: HEFZJCU01B795B.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgcttccttttacacctcccttgacttctggggccatacggaaccccggtccg

SEQ ID NO: 464880 - DNA, 498 bp, Homo sapiens
  misc_feature: HEFZJCU01B1R1B.53.81.H04.1.454.heavy.3.raw
cgcgtatacacacgaccggtgctcgatttagtagtgtagattcgcggggctgggagacgagcccagcactggaagtcgccggtgtttccattcggtgatcatcactgaacacagaggactcaccatggagtttgggctgagctgggttttcctcgttgctcttttaagaggtgtccagtgtcaagtgcaactggtggagtctgggggaggcgtggtccagcctggggggtccctgagactctcctgtgcagcctctggattcaccttcagcacctatcctatgcactgggtccgccaggctccaggcaagggactggagtgggtggcagttatatcatttgatggaagcactacatactacgcaaactccgtgaagggccgattcaccatctccagagacgattccaggaacactctgtttctccaaatgaacagcctgagagctgaggacacggctctttattactgtgcgagagattctggatacagccattatta

SEQ ID NO: 464881 - DNA, 506 bp, Homo sapiens
  misc_feature: HEFZJCU01BCEDX.51.78.H01.1.454.heavy.3.raw
cgatcgtatacacgaccggtgctcgatttagtgtgagtagtttgggtttgggggagaggagccccagccctgagattcccaggtgtttccattcagtgatcagcactgaacacagaggactcaccatggagttgggactgagctggattttccttttggctattttaaaaggtgtccagtgtgaagtgctactggtggagtctgggggaggcctggtacagcctggtaggtccctgagactctcctgtgcagcctctggattcacctttgatgattatgccatgcactgggtccggcaagctccagggaaggcctggagtgggtctcacgtattagttggaatagtggtagtatagcctatgcggactctgtgaagggccgattcaccatctccagagacaacgcaagaactccctgtatctgcaaatgaacagtctgagagctgaggacacggccttgtattactgcgacaaaagccaaggcaacagctggtactcaattagtac

SEQ ID NO: 464882 - DNA, 510 bp, Homo sapiens
  misc_feature: HEFZJCU01EKD9U.51.12.B01.1.454.heavy.3.raw
cgatcgtatacacgaccggtgctcgatttagtagtgtagattccgcgggggagagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcagggtcatcatgaccggggacacgtccatcgccacaacttacatggaactgaccagtctgacatttgacgacacggccgtctattactgtgcgacagaagcggcggacagaggttcgcttactggttcgaggctctccccc

SEQ ID NO: 464883 - DNA, 491 bp, Homo sapiens
  misc_feature: HEFZJCU01BTF3Y.11.13.B02.1.454.heavy.3.raw
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctcggcgccctgctccaggagcacctccgagagcacagcggccctgggctgcctggtcaggactacttccgtatctctcg

SEQ ID NO: 464884 - DNA, 509 bp, Homo sapiens
  misc_feature: HEFZJCU01B6ABR.52.78.H01.1.454.heavy.3.raw
cgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggtcagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcacc

SEQ ID NO: 464885 - DNA, 481 bp, Homo sapiens
  misc_feature: HEFZJCU01CFUPQ.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgtagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttccccctggcgccctgctccaggagcacctccgagagcacagcggccctgggctgcctggtcaaggactacttccagacgtatca

SEQ ID NO: 464886 - DNA, 497 bp, Homo sapiens
  misc_feature: HEFZJCU01EFZKM.13.86.H09.1.454.heavy.3.raw
tcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacagactatggacagaacctccagggcagattcaccatgacgacagacacatacacgaacacagcctacatggaggtgaggagcctgagatatgacgacacggccgtgtattattgtgcgagagtggagtggcaggtggatatcgacaaatttactacttaa

SEQ ID NO: 464887 - DNA, 509 bp, Homo sapiens; identical to SEQ ID NO: 445824
  misc_feature: HEFZJCU01EIYUA.9.14.B03.1.454.heavy.3.raw

SEQ ID NO: 464888 - DNA, 506 bp, Homo sapiens
  misc_feature: HEFZJCU01CBM94.4.81.H04.1.454.heavy.3.raw
agcactgtagcacgaccggtgctcgatttagtagtgtagattcgcggggtctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtctgggggaggcctggtcaaacctggggggtccctgagactctcgtgtgtagtctctgaattcatcttcagggactttgacatgaattgggtccgccaggctccagggaaggggctggagtgggtctcatccatcagttccagtactcgttacatatactacgcagactcagtgaggggccgattcaccatctccagagacaacgccaagaactcagtgtttctgcaaatgaacagcctgagagtcgaggactcggctgtctactactgtgcgaggaataagggagctaccctacgatttggacac

SEQ ID NO: 464889 - DNA, 509 bp, Homo sapiens
  misc_feature: HEFZJCU01DE0FH.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactgggcac

SEQ ID NO: 464890 - DNA, 525 bp, Homo sapiens
  misc_feature: HEFZJCU01B112A.19.86.H09.1.454.heavy.3.raw
tactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttcccctggcgccctgctccaggagcacctccgagagcacagccggccctcgggccg

SEQ ID NO: 464891 - DNA, 400 bp, Homo sapiens; identical to SEQ ID NO: 444452
  misc_feature: HEFZJCU01E08FH.47.24.C02.1.454.heavy.3.raw

SEQ ID NO: 464892 - DNA, 496 bp, Homo sapiens; identical to SEQ ID NO: 454107
  misc_feature: HEFZJCU01DAT28.40.81.H04.1.454.heavy.3.raw

SEQ ID NO: 464893 - DNA, 524 bp, Homo sapiens
  misc_feature: HEFZJCU01AQ2UF.10.85.H08.1.454.heavy.3.raw
catagtagtgcacgaccggtgctcgatttagtatcactcagtcgcgggggagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgagggggagccggctatggttcggacctcgtggggccaggggaacccctggtctacc

SEQ ID NO: 464894 - DNA, 467 bp, Homo sapiens; identical to SEQ ID NO: 445004
  misc_feature: HEFZJCU01BGCJ1.16.78.H01.1.454.heavy.3.raw

SEQ ID NO: 464895 - DNA, 506 bp, Homo sapiens; identical to SEQ ID NO: 464888
  misc_feature: HEFZJCU01BNNXS.4.81.H04.1.454.heavy.3.raw

SEQ ID NO: 464896 - DNA, 534 bp, Homo sapiens
  misc_feature: HEFZJCU01A3SBO.16.87.H10.1.454.heavy.3.raw
  modified_base (477)..(477): a, c, t, g, unknown or other
tgtactactccacgaccggtgctcgatttagcagtactgcgttgggtttgggggccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcgacatattaatctcgatgggagtaatttagcctacgcggactccgtcaagggccgattcaccgtctccagagacaacaccaagaacacactatatctgcagattgacagtctgagacccgaggacacggctgtgtattactgtgcaggcagttcgnggaacagttagtgggttggggggaggtttggggtttttttcgttacgttacgggtat

SEQ ID NO: 464897 - DNA, 481 bp, Homo sapiens
  misc_feature: HEFZJCU01C84JH.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaaggcccatcggtcttcccctgacaccctcctccaagagcacctctgggggcacagcggccctgggctgcctggtcaaggactacttcctagagacacg

SEQ ID NO: 464898 - DNA, 541 bp, Homo sapiens
  misc_feature: HEFZJCU01CE9N9.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggccgtttcatgtctggggccaagggacgctggtcaccgtctcttcagcctccaccaagggcccatcggtcttccccctcggtcaccctcctccaagagcacctctgggggcacagcc

SEQ ID NO: 464899 - DNA, 517 bp, Homo sapiens; identical to SEQ ID NO: 446891
  misc_feature: HEFZJCU01DM7N2.17.33.C11.1.454.heavy.3.raw

SEQ ID NO: 464900 - DNA, 501 bp, Homo sapiens; identical to SEQ ID NO: 457766
  misc_feature: HEFZJCU01BM8J1.11.27.C05.1.454.heavy.3.raw

SEQ ID NO: 464901 - DNA, 501 bp, Homo sapiens
  misc_feature: HEFZJCU01EZ205.48.22.B11.1.454.heavy.3.raw
agtatacatacacgaccggtgctcgatttagacgacagctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggcccgagcgcagtggctttttgatgcctttgatatgtggggccaagggacaatggtcaccgtcttcc

SEQ ID NO: 464902 - DNA, 484 bp, Homo sapiens; identical to SEQ ID NO: 445311
  misc_feature: HEFZJCU01DHBUV.11.23.C01.1.454.heavy.3.raw

SEQ ID NO: 464903 - DNA, 522 bp, Homo sapiens; identical to SEQ ID NO: 448016
  misc_feature: HEFZJCU01BT57Z.12.40.D07.1.454.heavy.3.raw

SEQ ID NO: 464904 - DNA, 506 bp, Homo sapiens
  misc_feature: HEFZJCU01CT0Y3.12.30.C08.1.454.heavy.3.raw
atacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtgctccatcagcagtggtgattattactggagttggatccgccagtccccagggaagggcctggagtggattgggtacatctatcacagtgggagcacctactacatcccgtccctgaagagtcgaattacgatgtcagtaaacacgtctaggaaccagttctccctgaagctgaggtctgtgactgccgcagacacggccgtctactactgtgccaggtgggctttgcgccagtggttcagagatgatcgcttcgattcgtggggccagggaattcg

SEQ ID NO: 464905 - DNA, 390 bp, Homo sapiens; identical to SEQ ID NO: 464043
  misc_feature: HEFZJCU01DU4SE.22.29.C07.1.454.heavy.3.raw

SEQ ID NO: 464906 - DNA, 520 bp, Homo sapiens
  misc_feature: HEFZJCU01BYD9Z.14.57.F02.1.454.heavy.3.raw
cgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgagatgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtattttgtgtgaaagatacgaagtctatgatacccaatttgggaggggcctttcat

SEQ ID NO: 464907 - DNA, 491 bp, Homo sapiens; identical to SEQ ID NO: 446104
  misc_feature: HEFZJCU01DTZID.3.34.D01.1.454.heavy.3.raw

SEQ ID NO: 464908 - DNA, 513 bp, Homo sapiens
  misc_feature: HEFZJCU01C3DXI.11.67.G01.1.454.heavy.3.raw
cgagagataccacgaccggtgctcgatttagagtatacatattggggggggcttggtgcagccgagggggtccctgagactctcctgtgtaggctctggattcagttttagcagctacgccatgacctgggtccgccaggctccagggaaggggctggagtgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtccagatattgcactggtggcaactgctacgacgcctactattatcaccacatggacgtctggggcaaagggaccacggtcatcgtctcctcagcctccaccaagggcccatcggtcttccccctggccaccctcctccaagagcacctctgggggcacagcggccctgggctgcctggtcaaggactacc

SEQ ID NO: 464909 - DNA, 484 bp, Homo sapiens; identical to SEQ ID NO: 445311
  misc_feature: HEFZJCU01AR81K.11.23.C01.1.454.heavy.3.raw

SEQ ID NO: 464910 - DNA, 498 bp, Homo sapiens
  misc_feature: HEFZJCU01AR1JT.51.71.G05.1.454.heavy.3.raw
cgatcgtatacacgaccggtgctcgatttagtgtcgtcgcaagagagagggggtctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagaggaactcgattacagcag

SEQ ID NO: 464911 - DNA, 481 bp, Homo sapiens
  misc_feature: HEFZJCU01B7NMV.11.63.F08.1.454.heavy.3.raw
cgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcactgggtgcgacaggcccctggacaagggcttgagtggatgggacggatcaaccctaatagtggtggcacaaactatgcacagaagtttgagggcagggtcatcatgaccagggacacgtccatcagcacagcctacatggagctgagcaggctgacatctgacgacacggccgtgtattactgtgcgagagataaaggggattgtgataacg

SEQ ID NO: 464912 - DNA, 527 bp, Homo sapiens
  misc_feature: HEFZJCU01EUWJJ.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcacgtctcctcagcctccaccaa

SEQ ID NO: 464913 - DNA, 497 bp, Homo sapiens
  misc_feature: HEFZJCU01EB2HC.12.38.D05.1.454.heavy.3.raw
  modified_base (372)..(372): a, c, t, g, unknown or other
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaatgccaagaactcactgtatttacacatggacggactgagagtcgaggacacggctgtttattactgtgcgagaactggaatcggaggatatagaggctatttagattcctggggccagggaancctggtcaccgtctcctcagcctccaccaaggcccatcggtcttcccctggcgcctgctccagagcacctccgagagcacagcggccctgggctgcctggtcaaggactacttcctacgtcgtat

SEQ ID NO: 464914 - DNA, 388 bp, Homo sapiens
  misc_feature: HEFZJCU01AGWNG.27.46.E02.1.454.heavy.3.raw
agcgtcgtctcacgaccggtgctcgatttagactcatctacagggaaagggactggaatttgtttcagctgttagtcctaatgggggtaacacatattacggagactccgtgaagggcagattcaccatctccagagacaattccaacaatacgttgtatcttcaaatgagcagtctgagagctgaggacacggctacattttattgtgtgaaagtccaagggccggaatactactttgactactggggccagggaaccctggtcaccgtctcctcagcttccaccaagggcccatccgtcttccccctcggcgccctgctccaggagcacctccgagagcacagccgccctgggctgcctggtcaaggactacttccagacgacgct

SEQ ID NO: 464915 - DNA, 535 bp, Homo sapiens
  misc_feature: HEFZJCU01CDTZV.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaagggcccatcggtcttcccctgcaccctcctccaagagcacctctggggcacagcc

SEQ ID NO: 464916 - DNA, 529 bp, Homo sapiens
  misc_feature: HEFZJCU01C88QP.19.86.H09.1.454.heavy.3.raw
tactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttcccctggcgccctgctccaggagcgacctccgagacgcacacgcggcccctcgggtccg

SEQ ID NO: 464917 - DNA, 496 bp, Homo sapiens; identical to SEQ ID NO: 445798
  misc_feature: HEFZJCU01BN7W1.12.55.E11.1.454.heavy.3.raw

SEQ ID NO: 464918 - DNA, 525 bp, Homo sapiens
  misc_feature: HEFZJCU01D61HF.53.10.A10.1.454.heavy.3.raw
cgcgtatacacacgaccggtgctcgatttagcgtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgccctccaggggggacctttggggtttcgacccctggggccagggaaccctggtcaccgtctcctcagcctccaccaagggcccatcggtcttcccctggcaccctcctccaagagcacctctgggggcacagcc

SEQ ID NO: 464919 - DNA, 521 bp, Homo sapiens; identical to SEQ ID NO: 445317
  misc_feature: HEFZJCU01EDC8X.12.40.D07.1.454.heavy.3.raw

SEQ ID NO: 464920 - DNA, 417 bp, Homo sapiens; identical to SEQ ID NO: 451677
  misc_feature: HEFZJCU01C6HQ6.40.20.B09.1.454.heavy.3.raw

SEQ ID NO: 464921 - DNA, 497 bp, Homo sapiens; identical to SEQ ID NO: 447711
  misc_feature: HEFZJCU01DOEFE.16.37.D04.1.454.heavy.3.raw

SEQ ID NO: 464922 - DNA, 493 bp, Homo sapiens
  misc_feature: HEFZJCU01ER68H.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaagggctggaatgggtctcatctattagtgcttactactggtggcacatacttcgcagactccgtgaagggccggttctccatctccagagacaattccaagaacacgctgtatctgcaattgaacagcctgagagccgagacacggccgtatattactgtgcgaaagagtttagggaatgaccacgtc

SEQ ID NO: 464923 - DNA, 509 bp, Homo sapiens; identical to SEQ ID NO: 444586
  misc_feature: HEFZJCU01AHJDY.12.78.H01.1.454.heavy.3.raw

SEQ ID NO: 464924 - DNA, 407 bp, Homo sapiens
  misc_feature: HEFZJCU01EOPHQ.40.22.B11.1.454.heavy.3.raw
tctagcgactcacgaccggtgctcgatttagacgacagctccagggaaggggctggagtgggtttcatacattagtagtagtagtagtaccatatactacgcagactctgtgaagggccgattcaccatctccagagacaatgccaagaactcactgtatctgcaaatgaacagcctgagagacgaggacacggctgtatattactgtgcgagagagccaggtggctacaattggagatactactactactacggtatggacgtctggggccaagggaccacggtctccgtctcctcagcttccaccaagggcccatcggtcttcccctggcgccctgctccaggagcacctctgggggcacagcggccctgggctgcctggtcaaggactacttccagtcgctaga

SEQ ID NO: 464925 - DNA, 512 bp, Homo sapiens
  misc_feature: HEFZJCU01B6R7D.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgactccggtgagcctacggcagcggcctttgactttctgggggccaggggacg

SEQ ID NO: 464926 - DNA, 513 bp, Homo sapiens
  misc_feature: HEFZJCU01EYFQC.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctgcgatctgacgacgcggccgtatattactgtgcgagagtacgtagcggctcgtctttgactacgtggggcctgggactcgtggtcaccgtct

SEQ ID NO: 464927 - DNA, 505 bp, Homo sapiens
  misc_feature: HEFZJCU01AKZZQ.14.78.H01.1.454.heavy.3.raw
cgtctagtaccacgaccggtgctcgatttagtgtgagtagtttgggtttgggggaggcttggtcaagcctggagggtccctgagactctcctgtgcagcctctggattcaccttcagtgactactacatgacctggatccgccaggcgccagggaaggggctggaatggattgcatacattcactatagtggaaatgcagtgtcctacgcagactctctgaagggccgattcaccgtctccagggacaacgccaagaactcgctgtatctgcaaatcgacggcctgagagtcgaggacacggccatgtattactgtgcgagagtgtggttcggtcatgtttagaagttggggcttttgaccactggggccagggaatcctggtcaccgtctcttcagcctccaccaagggcccatcggtcttcccctggcaccctcctccaagagcacctctgggggcacagcggccctgggctgcctggtcaaggactacttccgtactagacg

SEQ ID NO: 464928 - DNA, 498 bp, Homo sapiens
  misc_feature: HEFZJCU01D4FIX.52.37.D04.1.454.heavy.3.raw
cgcagtacgacacgaccggtgctcgatttagtagcatactgttgggtttggggatgctttctgagagtcatggatctcatgtgcaagaaaatgaagcacctgtggttcttcctcctgctggtggcggctcccagatgggtcctgtcccagctgcagctgcaggagtcgggcccaggcctggtaaagccttcggagaccctgtccctcacctgcactgtctctggtgcctccatcagcggtcatggttacttctggggctggatccgccagcccccagggaaggggctggagtggattggaaatatctattatagtgggagcacctcctactacaacccgtccctcaggagtcgagtcactatatccgtagacacgtccaagaaccagttctccctgaagctgagctctgtgaccgccgcagacacggctgtttattactgtgcgagacatctaagcaataatgtggatacacttatggagttgcattcctggggccac

SEQ ID NO: 464929 - DNA, 506 bp, Homo sapiens; identical to SEQ ID NO: 453061
  misc_feature: HEFZJCU01ENS2L.3.85.H08.1.454.heavy.3.raw

SEQ ID NO: 464930 - DNA, 481 bp, Homo sapiens; identical to SEQ ID NO: 448054
  misc_feature: HEFZJCU01AQ4H9.22.36.D03.1.454.heavy.3.raw

SEQ ID NO: 464931 - DNA, 493 bp, Homo sapiens
  misc_feature: HEFZJCU01ACK4U.4.28.C06.1.454.heavy.3.raw
agcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgaggggccgattcaccagtcttcagagacaacgccaaggacacgctgtatctggaaatgagcagtctgagagccgaggacacggctgtgtattactgtgcaagagataacggacttggtacgccctttgactactggggcccgggacctggtcaccgtctcctcggcctccaccaagggcccatcggtcttcccctggcgccctgctccaggagcacctccgagagcacagcggccctgggctgcctggtcaaaggactacgttccctacagtgct

SEQ ID NO: 464932 - DNA, 500 bp, Homo sapiens
  misc_feature: HEFZJCU01EPZU8.40.81.H04.1.454.heavy.3.raw
tctagcgactcacgaccggtgctcgatttagtagtgtagattcgcggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccactggggaccg

SEQ ID NO: 464933 - DNA, 518 bp, Homo sapiens
  misc_feature: HEFZJCU01B5X9H.11.13.B02.1.454.heavy.3.raw
cgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttccccctggccgccctgctccacggagcacctccgagagcacagcggcctcgggctc

SEQ ID NO: 464934 - DNA, 506 bp, Homo sapiens; identical to SEQ ID NO: 449588
  misc_feature: HEFZJCU01EBL2R.11.72.G06.1.454.heavy.3.raw

SEQ ID NO: 464935 - DNA, 533 bp, Homo sapiens
  misc_feature: HEFZJCU01EYT3P.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacggggcgtttattacttgtgcgagagggacggactacggtgactacgtgggggttcggaccccgtggggccgagggaaccctgggtcaccgtctcctcagcctccaccg

SEQ ID NO: 464936 - DNA, 509 bp, Homo sapiens
  misc_feature: HEFZJCU01DA6EK.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccgatcctccgggacagacttaccatgaccacgaactcctccataaacacagcctacatggagttgaggagcctgacatctgacgacacggccgtctattactgtgcgagagtcccacgatccggtgagcctacggcagcggcctttgacttctggggccagggacg

SEQ ID NO: 464937 - DNA, 504 bp, Homo sapiens; identical to SEQ ID NO: 455217
  misc_feature: HEFZJCU01A0ZUH.10.23.C01.1.454.heavy.3.raw

SEQ ID NO: 464938 - DNA, 514 bp, Homo sapiens
  misc_feature: HEFZJCU01CKQGV.13.71.G05.1.454.heavy.3.raw
tcacgtactacacgaccggtgctcgatttagtgtcgtcgcaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagcctggggggtccctgagactctcctgtcaagcctctgggttcagcttcagtgtatattggatgagctgggtccgccagactccagggaaggggctggagtgggtggccaacataaacacagacggaagtgacccatactatgcggactctgtgaagggccgattcaccatctccagagacaacgccaagaactcactatatttgcaaatggaccgcctgagagacgaggacacggctatgtattactgtgcgagagatgagagtggctacagttgggggccggggaaccctggtcaccgtcaa

SEQ ID NO: 464939 - DNA, 520 bp, Homo sapiens; identical to SEQ ID NO: 446666
  misc_feature: HEFZJCU01CRO2P.7.78.H01.1.454.heavy.3.raw

SEQ ID NO: 464940 - DNA, 510 bp, Homo sapiens
  misc_feature: HEFZJCU01APH4N.17.10.A10.1.454.heavy.3.raw
cgtagactagcacgaccggtgctcgatttagcgtcgatctcaggggtccgggagatcatgagggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaatttgataggctctatggactggacttctgggggccagggggaccacggtgatcgtctcatcagcctccaccaagggcccatccggtcttccccctggccaccctcctccaagagcacctcg

SEQ ID NO: 464941 - DNA, 485 bp, Homo sapiens
  misc_feature: HEFZJCU01EKSWK.49.27.C05.1.454.heavy.3.raw
agtcgagagacacgaccggtgctcgatttagacgcgatcgaagggtttggggagctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaacgtccgaagaacacgctgtatctgcaaatgaacaggctgagagctgaagacacggctgtatattactgtgcgtaaa

SEQ ID NO: 464942 - DNA, 490 bp, Homo sapiens
  misc_feature: HEFZJCU01B0P7H.51.52.E08.1.454.heavy.3.raw
cgatcgtatacacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagcctggggcctcagtgaaggtctcctgcaagacttctggatacaccttcaccgactactatatgcactgggtgcgacaggcccctggacaagggcttgagtggatgggatggatcgaccctaagaatggtgccacaaactatgcacagacttttcagggctgggtcaccatgaccagcgacacatctagcaacacagtctacatggagttgaccagcctgaccgacacggccgtgtatttttgttgtgagagattttcggactaatccagagaccccgt

SEQ ID NO: 464943 - DNA, 510 bp, Homo sapiens
  misc_feature: HEFZJCU01C9O3U.2.53.E09.1.454.heavy.3.raw
acgctcgacacacgaccggtgctcgatttagagagagtgtgttgggtttggggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctgggtgcgacaggcccctggacaagggcttgagtggatgggatggatcagtgcttacaacggtaacacaaactatgcacagaagttccagggcagagtcaccctgaccacagacacatccacgagcacagtcaacctggacctgaggagcctgacatctgacgacacggccgtgtattattgtgcgagaggacggagggggggagcggacgccttttgactactggggccagggaaccctggtcaccgtctcctcagcctccaccaaggccc

SEQ ID NO: 464944 - DNA, 492 bp, Homo sapiens
  misc_feature: HEFZJCU01EO1IN.11.13.B02.1.454.heavy.3.raw
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctggggctgcctgatcaaggactacttccgtatctctcg

SEQ ID NO: 464945 - DNA, 503 bp, Homo sapiens
  misc_feature: HEFZJCU01CMNVJ.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagacgtcccacgatccggtgagcctaggcagcggcctttgacttctc

SEQ ID NO: 464946 - DNA, 519 bp, Homo sapiens
  misc_feature: HEFZJCU01EEUF5.16.27.C05.1.454.heavy.3.raw
  modified_base (425)..(425): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcggtttatttcatatgatggaactactcaacactatccagactccggggagggccgattcaccgtctccagagacaattccaagaacagggtgtttcnccaagtgattgatctgagaagtgaggacacggctgtttattactgtgcgcggtgctgaccgctcttgactactgggggccggggagccccgggt

SEQ ID NO: 464947 - DNA, 497 bp, Homo sapiens
  misc_feature: HEFZJCU01ERAVU.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggccggttctccatctccagagacaattccaagaacacgctgtatctgcaattgaacagcctgagagccgaggaccacggccgtatattactgtgcgaaagtagtttaggggaatgaccacgtc

SEQ ID NO: 464948 - DNA, 519 bp, Homo sapiens; identical to SEQ ID NO: 445617
  misc_feature: HEFZJCU01APXQU.9.34.D01.1.454.heavy.3.raw

SEQ ID NO: 464949 - DNA, 525 bp, Homo sapiens
  misc_feature: HEFZJCU01EOU0I.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtccttccccctggccgcccgtgcctccaggagcacctccgagagcacagcgccct

SEQ ID NO: 464950 - DNA, 532 bp, Homo sapiens
  misc_feature: HEFZJCU01CBZA5.13.28.C06.1.454.heavy.3.raw
tcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagcctggggggtccctgagactctcctgtgtagcctctggatttgtttttagtgactattggatgagttgggtccgccaggctccagggaaggggctggagtgggtggccaacataaagtacgatgaagttgagataaattatttggactctgtgaagggccgattcaccatctcgagggacaacgccaagaactcgctgtatctgcaaatggagagcctgagagccgaggacacggctgtatattattgtgtgagattagcgcacttactttgactacgtggggccaggggaaccctggtcaccgt

SEQ ID NO: 464951 - DNA, 510 bp, Homo sapiens
  misc_feature: HEFZJCU01DGL1L.52.67.G01.1.454.heavy.3.raw
cgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccggacaagggcttgtttggatgggatggatcaacgctggcaatggtaacacaaaatattcacagaagttccagggcagagtcaccatcaccagggacacatccgcgagcacagcctacatggagttgagcagcctgagaaatgaagacacggctgtatattactgtgcgagaggggaaatggcctccaccaagggccatcggtcttcccctggcacctcctccaacg

SEQ ID NO: 464952 - DNA, 371 bp, Homo sapiens; identical to SEQ ID NO: 444435
  misc_feature: HEFZJCU01EZEQL.3.42.D09.1.454.heavy.3.raw

SEQ ID NO: 464953 - DNA, 501 bp, Homo sapiens
  misc_feature: HEFZJCU01CKJVL.48.34.D01.1.454.heavy.3.raw
agtatacatacacgaccggtgctcgatttagatcgtctgtgttgggaggtgtggtccagcctgggaagtccctgacactgtcctgcgcagcctctggattcaccttcaccacctttcgtatgcacttttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcacgtctcctcagcctccaccaagggcccatcggtcttcccctggcgccctgctccaggagcacctccgagagcacagcggccctgggctgcctggtcaaggactacttcctatgtatact

SEQ ID NO: 464954 - DNA, 505 bp, Homo sapiens
  misc_feature: HEFZJCU01EJODS.40.53.E09.1.454.heavy.3.raw
tctagcgactcacgaccggtgctcgatttagagagagtgtgttgggtttggggagcccccagagcacaactccttaccatggactggacctggaggatcctctttttggtggcagcagccacaggtgtccactcccaggtccagcttgtgcagtctggggctgaggtgaagaagcctggggcctcagtgaaggtttcctgcacggcttctggatacaccttcactagatatgctatacattgggtgcgccaggcccccggacaaagacttgagtggatgggatggatccaccctggcaattataacacaaaacattcacagaagttccagggcagagtcaccattaccagggacacatccgcgagcacagtctacatggagctgagcagcctgagatctgaagacacggctgtgtattactgtgcgacgaatagtggctgggcgagaggtgggatactactttgacttcgtggggccagggaaccctggtcaccgtctcctcacg

SEQ ID NO: 464955 - DNA, 501 bp, Homo sapiens
  misc_feature: HEFZJCU01EIMVF.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgttggagcttttgactactggggccagggaaccctggtcatcgtctcctcagcctccaccaaggcccatcggtcttcccctggcaccctcctccaagagcacctctgggggcacagcgccctggctgcctggtcaggactacttccgagtagtaca

SEQ ID NO: 464956 - DNA, 530 bp, Homo sapiens
  misc_feature: HEFZJCU01AXBG3.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaagtatggctgtgtttattgggcgaggagcctgtcaccg

SEQ ID NO: 464957 - DNA, 366 bp, Homo sapiens
  misc_feature: HEFZJCU01D7M9W.13.61.F06.1.454.heavy.3.raw
tcacgtactacacgaccggtgctcgatttagctacgctctaagggaaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctggggccaagggaccacggtcaccgtctcctcagcctccaccaagggcccatcggtcttccccctggcgccctgctccaggagcacctccgagagcacagcggccctgggctgcctggtcaaggactacttcctagtacgtga

SEQ ID NO: 464958 - DNA, 390 bp, Homo sapiens; identical to SEQ ID NO: 444541
  misc_feature: HEFZJCU01D9NZ7.16.24.C02.1.454.heavy.3.raw

SEQ ID NO: 464959 - DNA, 519 bp, Homo sapiens; identical to SEQ ID NO: 444867
  misc_feature: HEFZJCU01CW5L5.9.34.D01.1.454.heavy.3.raw

SEQ ID NO: 464960 - DNA, 529 bp, Homo sapiens
  misc_feature: HEFZJCU01BYN63.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctcccgagacgcacagcggccctgggctgcctggtcaaggactacttccacg

SEQ ID NO: 464961 - DNA, 528 bp, Homo sapiens
  misc_feature: HEFZJCU01DLJQE.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttgggccagggaaccctggtcaccgtctcctcagcctccaccaagggcccatcggtcttccccctggccaccctcctccaagagcacctctgggggcacagcggccctggctg

SEQ ID NO: 464962 - DNA, 507 bp, Homo sapiens
  misc_feature: HEFZJCU01AKC54.3.23.C01.1.454.heavy.3.raw
agacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaatgaacagcctggaagacgcggacacagccatgtattattgtacattaggacactatagtccctgggggccagggaaccctcgtccaccgtctcctcagcctccaccaaggcccatcggtcttcccctggccg

SEQ ID NO: 464963 - DNA, 499 bp, Homo sapiens; identical to SEQ ID NO: 452598
  misc_feature: HEFZJCU01DFHJ3.11.27.C05.1.454.heavy.3.raw

SEQ ID NO: 464964 - DNA, 499 bp, Homo sapiens
  misc_feature: HEFZJCU01DP8LB.48.38.D05.1.454.heavy.3.raw
agtatacatacacgaccggtgctcgatttagtatctgatagttgggtttggggggaagaggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttccccctggccgccctcgctccaggagcacctccgagagcacagcggccctgggctgcctggtcaaggactacttcctatgtatct

SEQ ID NO: 464965 - DNA, 488 bp, Homo sapiens; identical to SEQ ID NO: 452207
  misc_feature: HEFZJCU01B26K8.47.85.H08.1.454.heavy.3.raw

SEQ ID NO: 464966 - DNA, 501 bp, Homo sapiens; identical to SEQ ID NO: 445341
  misc_feature: HEFZJCU01CHB6Q.48.34.D01.1.454.heavy.3.raw

SEQ ID NO: 464967 - DNA, 520 bp, Homo sapiens
  misc_feature: HEFZJCU01DGX70.46.67.G01.1.454.heavy.3.raw
actagcagtacacgaccggtgctcgatttagagtatacatattgggtttggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattcttatgggcgctcccactacagtgcggccctccagagtcgagccctcatatccatagacacgtccaagaaccagtttccctgacgctgacgtctgtgaccgccgcagacacggctgtctattattgtgcgagactagccttctgtagtgggggtacttgcaacccgggatactactcctaccttcggcttggacatctgggggtccggac

SEQ ID NO: 464968 - DNA, 516 bp, Homo sapiens
  misc_feature: HEFZJCU01BU09Z.46.67.G01.1.454.heavy.3.raw
actagcagtacacgaccggtgctcgatttagagtatacatattgggtttggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattcttatgggcgctcccactacagtgcggccctccagagtcgagccctcatatcccatagacacgtccaagaaccagtttccctgacgctgacgtctgtgaccgccgcagacacggctgtctattattgtgcgagactagccttctgtagtgggggtacttgcaacccgggatactactccaccttcggcttggacatctgggccgac

SEQ ID NO: 464969 - DNA, 526 bp, Homo sapiens
  misc_feature: HEFZJCU01DYDOQ.16.87.H10.1.454.heavy.3.raw
tgtactactccacgaccggtgctcgatttagcagtactgcgttgggtttgggggccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaagggctggtgtgggtctcacatattaatctcgatgggataatttagcctacgcggactccgtcaagggccgattcaccgtctccagagacaacaccaagaacacactatatctgcagattgacagtctgagacccgaggacacggctgtgtattactgtgcaaggcagttcgtggaaacagttatggttggggggagttgggtttttttttcgtactacgggat

SEQ ID NO: 464970 - DNA, 533 bp, Homo sapiens
  misc_feature: HEFZJCU01AN0YC.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttaataaattatgcggactccgtgaggggccgattcagcatctccagagacaacggcaagagtatactgtatctggaaatgaacaatctgagagtcgacgatacggctgtctatcatttgttgttttcgatcgtccttccggtcccggccggggtactttcggtcgggggccgaacggggaaccccttc

SEQ ID NO: 464971 - DNA, 486 bp, Homo sapiens
  misc_feature: HEFZJCU01CPZVG.53.33.C11.1.454.heavy.3.raw
cgcgtatacacacgaccggtgctcgatttagagtgagctcgttgggtttggggagacgagcccagcactggaagtcgccggtgtttccattcggtgatcatcactgaacacagaggactcaccatggagtttgggctgagctgggttttcctcgttgctcttttaagaggtgtccagtgtcacgtgcagctggtgcagtctgggggagcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcacatctccagagacaattccaagaacacactgtatctgcaaatggacagcctgagagctgaagacacggctgtgtattactgtgcgagtgagatgtcttacgt

SEQ ID NO: 464972 - DNA, 496 bp, Homo sapiens; identical to SEQ ID NO: 446600
  misc_feature: HEFZJCU01EBMSA.4.21.B10.1.454.heavy.3.raw

SEQ ID NO: 464973 - DNA, 532 bp, Homo sapiens; identical to SEQ ID NO: 445228
  misc_feature: HEFZJCU01AWK97.7.78.H01.1.454.heavy.3.raw

SEQ ID NO: 464974 - DNA, 527 bp, Homo sapiens; identical to SEQ ID NO: 451879
  misc_feature: HEFZJCU01AJV0B.7.78.H01.1.454.heavy.3.raw

SEQ ID NO: 464975 - DNA, 488 bp, Homo sapiens; identical to SEQ ID NO: 448226
  misc_feature: HEFZJCU01AEIWC.18.70.G04.1.454.heavy.3.raw

SEQ ID NO: 464976 - DNA, 383 bp, Homo sapiens
  misc_feature: HEFZJCU01DAIKD.47.77.G11.1.454.heavy.3.raw
agctcacgtacacgaccggtgctcgatttagctagtcactcaagggtaaagggggctggagtgggtctcacggcattggtggtagtggtgccaggacacattacggtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 464977 - DNA, 530 bp, Homo sapiens
  misc_feature: HEFZJCU01DNKEI.40.68.G02.1.454.heavy.3.raw
tctagcgactcacgaccggtgctcgatttagtcgatagtgaagggaaaggggagggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagaccacgtccaagaccaattctccctgaagctgagctctgtgaccgcccgcagacacggctgtctattactgtgcgaggccccgagccgcagtggcgtttttgatgtccgttttgaacttatggttgggggacccgaaggggtacaaagtgggtacccg

SEQ ID NO: 464978 - DNA, 379 bp, Homo sapiens; identical to SEQ ID NO: 444450
  misc_feature: HEFZJCU01CFP7U.47.77.G11.1.454.heavy.3.raw

SEQ ID NO: 464979 - DNA, 505 bp, Homo sapiens
  misc_feature: HEFZJCU01DS3O3.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgtaccttttctggtatttcgatctctggggccgtggcaccctggtcactgtctcctcggcttccaccaagggcccatccggtcttcccctggccgcctgctccaggagcacctcgtggggc

SEQ ID NO: 464980 - DNA, 517 bp, Homo sapiens
  misc_feature: HEFZJCU01DWB1H.13.76.G10.1.454.heavy.3.raw
  modified_base (488)..(488): a, c, t, g, unknown or other
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgagggccgattcaccatcctccagagacaattccaagaacacgctgtttcttcaaatgaacagcctgagagccgatgacacggccgtgtattactgtgcgagagatggggcccacgaacgttacncgctatggacgtctggggccaagggaccg

SEQ ID NO: 464981 - DNA, 518 bp, Homo sapiens
  misc_feature: HEFZJCU01CAFJS.5.78.H01.1.454.heavy.3.raw
atcagacacgcacgaccggtgctcgatttagtgtgagtagtttgggtttggggggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatgactccgtgaagggccgattcaccatctccagagacaattccaagaacactctgtatctgcaaatggacagcctgagacctgaggacacggctgtgtattactgtgcgaaagaaccggcgggcagtggctgggcccatttgaccactggggccagggaaccctggtcaccgtctcctcagcctccaccaagggcccatcggtcttccccctggccaccctcctccaagagcacctctgggggcacagcggccctgggctgcctggtcaaggactacttccg

SEQ ID NO: 464982 - DNA, 513 bp, Homo sapiens; identical to SEQ ID NO: 452397
  misc_feature: HEFZJCU01DUQAJ.47.55.E11.1.454.heavy.3.raw

SEQ ID NO: 464983 - DNA, 506 bp, Homo sapiens
  misc_feature: HEFZJCU01B3O0O.49.20.B09.1.454.heavy.3.raw
agtcgagagacacgaccggtgctcgatttagtgtagtgtgaaggggacccaacaaccacatccctcctcagaagccccagagcacaacgcctcaccatggactggacctggaggatcctctttttggtggcagcagccacaggtgcccactcccaggtccagcttgtgcagtctggggctgagttgaagaagcctggggcctcagtgagggtttcctgcgtggtctccggatacaccttcactagtcatcctatgcattgggtgcgccaggcccccggacaaaggtttgagtggatgggatggatcaccgctggcaatggtgacacaaaatattcagagaagttccagggcagagtctccattaccagggacacagctgcgagtacagggtacatggaactgagtggcctgagatctgaggacacggctgtttatactgtgcgagagggaagtgggatattgtggcagctccaggtgcccagccgggccctacgtttgactacgtc

SEQ ID NO: 464984 - DNA, 375 bp, Homo sapiens; identical to SEQ ID NO: 446168
  misc_feature: HEFZJCU01A9ISI.13.78.H01.1.454.heavy.3.raw

SEQ ID NO: 464985 - DNA, 525 bp, Homo sapiens
  misc_feature: HEFZJCU01CB487.53.58.F03.1.454.heavy.3.raw
cgcgtatacacacgaccggtgctcgatttagtctgatcgagaagggaaaggggcacaagaacatgaaacacctgtggttcttcctcctcctggtggcagctcccagatgggtcctgtcccaggtgcagctgcagcagtggggctcaggactgttgaagccttcggagaccctgtccctcacgtgcgctgtctatggtgggtcattcagtgattattattggacctggatccgccaggccccagggaaggggctggagtggatagcggaaatcaatcatagtggaaagactacctacaacccgtccctcaagagtcgagtcaccttatcggtagacacgcccaagaagcagttctccctgagggtgacgtctgtgaccgccgcggacacgggctgtctattactgtgcgagaggccccttagttcggttttggactggttctcccatggaatcctactttgagtactgggccgcggagccctggtcaccgtctcctcagcctccaccaggcccatcggtcttcccc

SEQ ID NO: 464986 - DNA, 540 bp, Homo sapiens
  misc_feature: HEFZJCU01DXM5W.16.39.D06.1.454.heavy.3.raw
tgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccagggaaggggctggaatgggtctcagttattgaaaatgatggtgacacaatctacgccgactccgtgaagggccgattcaccatctccagagacaattccaagaacacggtgaatctcaaatgaacagcctgagaaccgaggacacggccgtatattattgtataggttatggtggtaattcggccctggggccagggaaccgtggtcaccgtctcctcagcctccaccg

SEQ ID NO: 464987 - DNA, 518 bp, Homo sapiens
  misc_feature: HEFZJCU01BWI8U.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccagggaccctggtcatcgtctcccagcctccaccaaggcccatcggtcttcccctggcg

SEQ ID NO: 464988 - DNA, 387 bp, Homo sapiens; identical to SEQ ID NO: 445229
  misc_feature: HEFZJCU01CI6EN.11.20.B09.1.454.heavy.3.raw

SEQ ID NO: 464989 - DNA, 389 bp, Homo sapiens
  misc_feature: HEFZJCU01APB0R.19.45.E01.1.454.heavy.3.raw
tactctcgtgcacgaccggtgctcgatttagtgagtcagtaagggaagggactggagtgggtttcatacattagtagtagtagtagcaccatatactacgcagactctgtgaagggccgattcaccatctccagagacaatgccaagaactcactgtatctgcaaatgaacagcctgagagccgaggacacggctgtgtattactgtgcgagaactaggatatccgggagggccgcttttgactactggggccagggaaccctggtcaccgtctcctcagcctccaccaagggcccatcggtcttccccctggcgccctgctccaggagcacctccgagagcacagcggccctgggctgcctggtcaaggactacttcccacgagagta

SEQ ID NO: 464990 - DNA, 521 bp, Homo sapiens
  misc_feature: HEFZJCU01EM3XX.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatgggtctcagttattcataccgacggtaccatatatgacgcagactccgtgaagggccgattcaccatctccagagaccattccaagaacaccctatatcttcaaatgaacaacctgagagtcgaagacacggccgtatattactgtgcgagacatgacttcggtgaccccgtggggccagggaaccctggtcaccgtctcctcacg

SEQ ID NO: 464991 - DNA, 508 bp, Homo sapiens
  misc_feature: HEFZJCU01DO6HQ.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaaccctccaccggcacagcctacatggagctgagcagtctgacacctgacgacacggccgtctattactgtgcgagagccgcgaatatgtggtgcaaagatggtcgttgtttgtttggccggtgaactactggggccagggcaccctggtcaccgtctcctcagcttccaccaagggcccatcggtcttcccctggcgccctgctccaggagcacctctgggggcacagcggccctgggctgcctggtcaaggactactcccata

SEQ ID NO: 464992 - DNA, 457 bp, Homo sapiens; identical to SEQ ID NO: 462072
  misc_feature: HEFZJCU01D86P0.15.28.C06.1.454.heavy.3.raw

SEQ ID NO: 464993 - DNA, 494 bp, Homo sapiens
  misc_feature: HEFZJCU01C5NL4.48.59.F04.1.454.heavy.3.raw
agtatacatacacgaccggtgctcgatttagtacacacacttagggattggggacccaacaaccacatccctcctcagaagcccccagagcacaactccgtaccatggactggacctggaggatcctctttttggtggcagcagccacaggtgcccactcccaggtccagcttgtgcaatctgggactgaactgaagaagcccgggggctctgtgagggtttcatgcaaggcctctggatactcgttcacaacctacactatgcattgggtgcgccaggcccccggacaaagccttgagtggatggggtggctcaacgctggcgatggtcagacaaagtattcacagaagttccagggcagagtcaccatcaccagggacacgtccgcgagtagtgtcttcatggagctgcgcagtctgagatcggaagacacggcagtatattactgtgcgagaggcggatattgtcgtcgaggtgactgctacagtcaaaat

SEQ ID NO: 464994 - DNA, 512 bp, Homo sapiens
  misc_feature: HEFZJCU01EN2SU.12.1.A01.1.454.heavy.3.raw
atacgacgtacacgaccggtgctcgatttagacgtctcatcagggggggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagtagtagttattactactggggctggatccgccagcccccaggggaggggctgaagtggattgggagtgtctattatagtgggatcacctactacaacccgtccctcaagagtcgagtcaccatatccgtcgacacgtccaagaccagttctccctgaagctgagctctgtgaccgccgcagacacggctgtgtattactgtgcgagacagccaagacagattttggagtggttactgttggactacttttgactacgtggggccaggggaaccctggt

SEQ ID NO: 464995 - DNA, 310 bp, Homo sapiens; identical to SEQ ID NO: 446406
  misc_feature: HEFZJCU01B9RHJ.22.28.C06.1.454.heavy.3.raw

SEQ ID NO: 464996 - DNA, 520 bp, Homo sapiens; identical to SEQ ID NO: 447034
  misc_feature: HEFZJCU01DW4UK.16.10.A10.1.454.heavy.3.raw

SEQ ID NO: 464997 - DNA, 493 bp, Homo sapiens; identical to SEQ ID NO: 455531
  misc_feature: HEFZJCU01DLCQU.47.85.H08.1.454.heavy.3.raw

SEQ ID NO: 464998 - DNA, 497 bp, Homo sapiens
  misc_feature: HEFZJCU01BWZMH.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttcccctggcgccctgctccaggagcacctccgagagcacagcggcccgtgggctgcctggtcaaggactac

SEQ ID NO: 464999 - DNA, 519 bp, Homo sapiens; identical to SEQ ID NO: 452709
  misc_feature: HEFZJCU01DX5JL.3.82.H05.1.454.heavy.3.raw

SEQ ID NO: 465000 - DNA, 524 bp, Homo sapiens
  misc_feature: HEFZJCU01A1X1K.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgaccttttgtgactgccgcggacacggccgtgtattactgtgcgagagacccctccgatagcagtggctggtccactaggtttgactactggggccaggggaagctttggtcaccgtctccctcagcct

SEQ ID NO: 465001 - DNA, 509 bp, Homo sapiens; identical to SEQ ID NO: 454842
  misc_feature: HEFZJCU01BDGKX.2.33.C11.1.454.heavy.3.raw

SEQ ID NO: 465002 - DNA, 406 bp, Homo sapiens
  misc_feature: HEFZJCU01EJB7D.51.72.G06.1.454.heavy.3.raw
cgatcgtatacacgaccggtgctcgatttagctacgactgcaagggaaaggggctggagtgggtggcagttatttcatatgatggaagtaaaatattctatgtagactccgtgaagggccgcttcatcatctccagagacaattcccagaacaccctgtttctgcaaatgcacagcctgagacctgaggacacggctgtgtattactgtgcgaacttaatcacggaggacaacggtgacccccgtccgctcggtgcggaggtctggggccaagggaccacggtcatcgtctcctcagcctccacccagggcccatcggtcttccccctggcaccctcctccaagagcacctctgggggcacagcggccctgggctgcctggtcaaggactacttcctcgtagcact

SEQ ID NO: 465003 - DNA, 531 bp, Homo sapiens
  misc_feature: HEFZJCU01EA6PD.19.48.E04.1.454.heavy.3.raw
tactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagcctggggggtccctgagactctcctgtacaggctctgggttctcctttagtagttattggatgaactgggcccgccaggctccggggaagggccggagtgggtggccaacataatgcaagatggaactgagaaaaactatggggactctgtgaagggccgattcaccatctccagagacaaccgtaagaacttactgtttctgcaaatgaacagcctgagagccgaggacacggctgtgtattattgtgcgaagggcagtggctggggacatggacgtctggggccaagggaccacggtcaccgt

SEQ ID NO: 465004 - DNA, 505 bp, Homo sapiens; identical to SEQ ID NO: 447076
  misc_feature: HEFZJCU01D0UHC.10.38.D05.1.454.heavy.3.raw

SEQ ID NO: 465005 - DNA, 507 bp, Homo sapiens
  misc_feature: HEFZJCU01EV49W.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccaataaacacagcctacatggagttgaggagcctgacatctgacgacacggccgtctattactgtgcgagacgtcccacgatccggtgacgcctacggcaggcggtcctttgacttcg

SEQ ID NO: 465006 - DNA, 506 bp, Homo sapiens
  misc_feature: HEFZJCU01CBLVL.40.3.A03.1.454.heavy.3.raw
tctagcgactcacgaccggtgctcgatttagagagcgtcacagaggagaagggggagtctccctcactgcccagctgggatctcagggcttcattttctgtcctccaccatcatggggccaaccgccatcctcgccctcctcctggctgttctccaaggagtctgcgccgaggtgcagctggtgcagtctggagcagaggtgaaaagcccggagagtctctgaagatctcctgtaaggcttctggatacaaattcaccaactactggatcggctgggtgcgccagatgcccgggaaaggcctggagtggatgggaatcatctatcctgctgactccgataccagatacggcccttccttcgaaggccaggtcaccatttcagccgacaagtccgtcagcaccgcctacctgcagtggagcagcctgaaggcctcggacaccgccatgtattactgtgcgaggaggggggagtgggtggttgggtcgagtctactttgtactccgtc

SEQ ID NO: 465007 - DNA, 517 bp, Homo sapiens
  misc_feature: HEFZJCU01ETGOX.3.20.B09.1.454.heavy.3.raw
  modified_base (410)..(410): a, c, t, g, unknown or other
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcgaacagactacggtggcaactcctatgcttttgatatntggggccaagggacaatggtcaccgtctcttcagcctccaccaagggcccatcggtcttcccctcggcaccctcctccaagagcacctctgggggcacagcggcccg

SEQ ID NO: 465008 - DNA, 537 bp, Homo sapiens
  misc_feature: HEFZJCU01ENJDW.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccgaggggaccctggtcatcgtcctccccacgccctccaccaacgggcccatcggtcctttccccctggccgcccgtcg

SEQ ID NO: 465009 - DNA, 506 bp, Homo sapiens
  misc_feature: HEFZJCU01EYU8D.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgacgcctacggcagccggcctttgacttcgtc

SEQ ID NO: 465010 - DNA, 509 bp, Homo sapiens
  misc_feature: HEFZJCU01C7N2C.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaaggccgatcaccatctccagagacaactccaggaacacaatgtatttggacctgaacagcctaagtcctgaggacacgggtgtatactactgtacgaaggagggggaacagcgggagtcaagtactctttg

SEQ ID NO: 465011 - DNA, 531 bp, Homo sapiens; identical to SEQ ID NO: 448278
  misc_feature: HEFZJCU01EA6YK.19.48.E04.1.454.heavy.3.raw

SEQ ID NO: 465012 - DNA, 513 bp, Homo sapiens
  misc_feature: HEFZJCU01B0V95.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctgggccgtggcaccctggtcactgtctcctcggcttccaccaagggcccatcggtcttcccctggcgccctgctccaggagcacctctgggggcacagcggcccg

SEQ ID NO: 465013 - DNA, 517 bp, Homo sapiens; identical to SEQ ID NO: 445684
  misc_feature: HEFZJCU01AD9KP.9.34.D01.1.454.heavy.3.raw

SEQ ID NO: 465014 - DNA, 510 bp, Homo sapiens
  misc_feature: HEFZJCU01BA8YJ.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctaggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaagggctggtgtgggtctcacgtatcaatcctgatggcagtgttataaattatgcggactccgtgagggccgattcagcatctccagagacaacggcaagagtatactgtatctggaaatgaacaatctgagagtcgacgatacggctgtctatcattgtgtttcgattgccttcggtccgcgggacttcgtggggccagggtacccg

SEQ ID NO: 465015 - DNA, 356 bp, Homo sapiens; identical to SEQ ID NO: 444460
  misc_feature: HEFZJCU01EEDT4.47.38.D05.1.454.heavy.3.raw

SEQ ID NO: 465016 - DNA, 391 bp, Homo sapiens; identical to SEQ ID NO: 444514
  misc_feature: HEFZJCU01BXY8T.12.24.C02.1.454.heavy.3.raw

SEQ ID NO: 465017 - DNA, 483 bp, Homo sapiens
  misc_feature: HEFZJCU01DTAML.19.71.G05.1.454.heavy.3.raw
tactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagaggccccatagacatgccacctcgtctctggtgcta

SEQ ID NO: 465018 - DNA, 517 bp, Homo sapiens
  misc_feature: HEFZJCU01BJV6N.10.53.E09.1.454.heavy.3.raw
catagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcgtcgggggaataccttcagcactggggccagggcaccctggtcaccgtctcctcagcctccaccaaggcccatcggtcttcccctggcaccctcctccaagagcacctctggggc

SEQ ID NO: 465019 - DNA, 502 bp, Homo sapiens
  misc_feature: HEFZJCU01DST7W.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctgggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaatttgataggctctatggactggacttctc

SEQ ID NO: 465020 - DNA, 327 bp, Homo sapiens; identical to SEQ ID NO: 444439
  misc_feature: HEFZJCU01ERKZL.40.20.B09.1.454.heavy.3.raw

SEQ ID NO: 465021 - DNA, 379 bp, Homo sapiens; identical to SEQ ID NO: 444450
  misc_feature: HEFZJCU01C4QTQ.47.77.G11.1.454.heavy.3.raw

SEQ ID NO: 465022 - DNA, 499 bp, Homo sapiens
  misc_feature: HEFZJCU01AK41I.13.11.A11.1.454.heavy.3.raw
tcacgtactacacgaccggtgctcgatttagctacgactgcagggagctctgggagaggagccccagccctgagattcccacgtgttgccattcggtgatcagcgctgaacacagaggactcgccatggagtttgggctgagctgggttttccttgttgctattttaaaaggtgtccagtgtgaggtgcagctggtagagtctgggggaggtgtggtacggcctggggggtccctcagactctcctgtgcaacctctggattcagatttgatgagtatggcatacactgggtccgccaacctccagggaaggggctgcagtgggtctctggtataaactggaatggtgccagcacaacttatgcagactctgtgaagggccgattcaccatctccagagacagtgccgagaactccgtacatctgcaaatgaacagtctcggagtcgaggacacggccttgtatttctgtgcgaggttagcagtggctggtacttacgc

SEQ ID NO: 465023 - DNA, 497 bp, Homo sapiens; identical to SEQ ID NO: 445179
  misc_feature: HEFZJCU01BSQXN.12.55.E11.1.454.heavy.3.raw

SEQ ID NO: 465024 - DNA, 502 bp, Homo sapiens
  misc_feature: HEFZJCU01DCLRR.47.55.E11.1.454.heavy.3.raw
  modified_base (452)..(452): a, c, t, g, unknown or other
agctcacgtacacgaccggtgctcgatttagcactcgcacgttgggtttgggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggntgtctatcattgtgttttcgatgcctttcggtccgcggggacttctgggg

SEQ ID NO: 465025 - DNA, 571 bp, Homo sapiens
  misc_feature: HEFZJCU01DV5KS.16.87.H10.1.454.heavy.3.raw
tgtactactccacgaccggtgctcgatttagcagtactgcgttgggtttgggctgatctgggtcttccttgttgctttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagtctgacgacccgaggacacggctgtgtattactgtgcaaggcagttcgtggaaacagttatgggttggggggagtttggggtttttttttcgttacgttacgggatgggacgttcgtggggccgaggggaccgcggtcaccgtctcctcacgcctccacccgaagggccccagtcggttccttcccccgtggccacccctcctaccaagacgcaccttc

SEQ ID NO: 465026 - DNA, 513 bp, Homo sapiens; identical to SEQ ID NO: 445573
  misc_feature: HEFZJCU01CSQ4R.52.34.D01.1.454.heavy.3.raw

SEQ ID NO: 465027 - DNA, 521 bp, Homo sapiens
  misc_feature: HEFZJCU01DR0K3.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacggaacgttactacgctatggacgtcgtggggccaagggaccg

SEQ ID NO: 465028 - DNA, 401 bp, Homo sapiens; identical to SEQ ID NO: 454109
  misc_feature: HEFZJCU01EF1OT.10.77.G11.1.454.heavy.3.raw

SEQ ID NO: 465029 - DNA, 379 bp, Homo sapiens; identical to SEQ ID NO: 444450
  misc_feature: HEFZJCU01CIICN.47.77.G11.1.454.heavy.3.raw

SEQ ID NO: 465030 - DNA, 519 bp, Homo sapiens; identical to SEQ ID NO: 446650
  misc_feature: HEFZJCU01CBSP1.13.76.G10.1.454.heavy.3.raw

SEQ ID NO: 465031 - DNA, 541 bp, Homo sapiens
  misc_feature: HEFZJCU01BMQDV.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggtgaactactgggccagggcaccctggtcaccgtctcctcagcttccaccaagggcccatcggtcttcccctggccgccctctccacgagacgacctactcgggtcggacgacgcggccgtccggtcgcgtccgtcggtcgtacggtaacgtaccgttaccctacctaccttaccg

SEQ ID NO: 465032 - DNA, 496 bp, Homo sapiens
  misc_feature: HEFZJCU01D3KLE.12.2.A02.1.454.heavy.3.raw
atacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgagtggatgggatggatcagcgcttacaatggtaacacagactatgcacagaagttccaggacagagtcaccatgaccacagacacatccacgagcacagcctacatggagctgaggagcctgagatctgacgacacggccgtgtattactgtgcgagaggttttagtgatacttattgtagtggtggtacctgctactttttc

SEQ ID NO: 465033 - DNA, 522 bp, Homo sapiens
  misc_feature: HEFZJCU01EFXNU.51.83.H06.1.454.heavy.3.raw
cgatcgtatacacgaccggtgctcgatttagatcacgtgcgtcgcggggcggggggaagaggaagactgacggtcctcccaggagttcaggtgcagctggtggactctgggggaggcgtggtccagcctgggaggtccctgcgactctcctgtgcagcctctggattcagcttcagggctaatactatgttctgggtgcgccaggctccaggcaaggggctggagtgggtggcagtcatctggcctgatggaggtttaacatactatgcggactccgtggagggccgattcaccgtctccagagacaactccaaaacacgctgtatctccaaatgaacagcctcagatctgaggacacggctatctactactgtgtgaaagaattgggtttcagtggctactttgacttctggggccagggaaccctggtcaccgtctcctcagcttccaccaagggcccatcggtccttccccctggccgccctgctccaggagcacctctgggggcacgagcggcccgtc

SEQ ID NO: 465034 - DNA, 506 bp, Homo sapiens
  misc_feature: HEFZJCU01BZ3KL.47.48.E04.1.454.heavy.3.raw
  modified_base (473)..(473): a, c, t, g, unknown or other
agctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccagggaaggggctggagtgggttggcaacataaatccagatggaagtcagaaaacctatgtggactctctgaagggccgattcaccatctccagagacaacgccaagaactctctgtttctgcaatggacagcctgagagtcgaagacacggctgtgtattactgtntgtctctgacgcctcggccggaccttggcttcg

SEQ ID NO: 465035 - DNA, 518 bp, Homo sapiens
  misc_feature: HEFZJCU01E10QB.47.46.E02.1.454.heavy.3.raw
agctcacgtacacgaccggtgctcgatttagactcatctacagggaaagggggagagaggagcccagccctgggattttcaggtgttttcatttggtgatcaggactgaaccgagagaactcaccatggagtttgggctgagctggctctttcttgtggcttttttaaaaggtgtccagtgtgaggtgcaactgttggagtctgggggagacttagtacaccctggggggtccctgagactctcctgtgcagcctctggactcacctttagcaactctgtcatgggctgggtccgccaggctccggggaagggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatattctgtgcgaaagtctatagcagtgcccctacgcgcacttctttgacttctgggcc

SEQ ID NO: 465036 - DNA, 518 bp, Homo sapiens; identical to SEQ ID NO: 459134
  misc_feature: HEFZJCU01EX55H.9.43.D10.1.454.heavy.3.raw

SEQ ID NO: 465037 - DNA, 481 bp, Homo sapiens
  misc_feature: HEFZJCU01C88OU.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctcagagacaattccagaaacaactgtatcttcaaataacagtctgagacttgaggacacggctgtctattactgtgcgagagactacggtgaccttttctggtatttcgatctctgggccgtggcacctgtcactgtctctcggcttccaccaagggcccatcggtccttcccctggccgcctcgctcca

SEQ ID NO: 465038 - DNA, 520 bp, Homo sapiens; identical to SEQ ID NO: 457896
  misc_feature: HEFZJCU01BNHN9.13.76.G10.1.454.heavy.3.raw

SEQ ID NO: 465039 - DNA, 374 bp, Homo sapiens; identical to SEQ ID NO: 444640
  misc_feature: HEFZJCU01AM4CO.7.37.D04.1.454.heavy.3.raw

SEQ ID NO: 465040 - DNA, 371 bp, Homo sapiens; identical to SEQ ID NO: 444435
  misc_feature: HEFZJCU01CH8KO.3.42.D09.1.454.heavy.3.raw

SEQ ID NO: 465041 - DNA, 400 bp, Homo sapiens; identical to SEQ ID NO: 444452
  misc_feature: HEFZJCU01BITQL.47.24.C02.1.454.heavy.3.raw

SEQ ID NO: 465042 - DNA, 521 bp, Homo sapiens
  misc_feature: HEFZJCU01CN2YJ.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacacagactctgtgaagggccgattcaccatctccagggacaacgccaagaactcactgactttgcaaatgaacaccctgcgagccgaggacacggccgtatattactgtgcgagaataacccgttcgcctggttattaccttgacacttgggccagggaaccctggtcaccgtctcctcagcctccaccaagggcccatcggtcttcccctggcgccctgctccagagcacctccgagagcacagcggcctgggctgcctggtcaaggactacttcc

SEQ ID NO: 465043 - DNA, 524 bp, Homo sapiens; identical to SEQ ID NO: 446401
  misc_feature: HEFZJCU01BZZ6B.3.82.H05.1.454.heavy.3.raw

SEQ ID NO: 465044 - DNA, 527 bp, Homo sapiens
  misc_feature: HEFZJCU01DUAK7.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttattacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggccaaggaccgacgg

SEQ ID NO: 465045 - DNA, 536 bp, Homo sapiens
  misc_feature: HEFZJCU01A8Z2O.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctcctgaggctgagctctgtgacagccgcggacacgggcgtttattactgtgcgagagggacggacgtacggtgactacgtgggggttccgaccccgtgggccgacgggaacccgtcggtcgaccgtctcctcagccctaccacccg

SEQ ID NO: 465046 - DNA, 538 bp, Homo sapiens
  misc_feature: HEFZJCU01BFGSH.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaaccaggtggtccttacaatgaccaccatggaccctgtggacacagccacatatttctgtgcacactctataggagcacctggtagtctgccaaactggttcgaccccgtggggcccggacccgtggtccaccgtctcctcagcctccaccaacgggcccatcggtccttccccgtc

SEQ ID NO: 465047 - DNA, 491 bp, Homo sapiens; identical to SEQ ID NO: 445531
  misc_feature: HEFZJCU01A9GAE.11.38.D05.1.454.heavy.3.raw

SEQ ID NO: 465048 - DNA, 403 bp, Homo sapiens; identical to SEQ ID NO: 444540
  misc_feature: HEFZJCU01DXFCG.16.72.G06.1.454.heavy.3.raw

SEQ ID NO: 465049 - DNA, 490 bp, Homo sapiens; identical to SEQ ID NO: 446389
  misc_feature: HEFZJCU01DZ2O1.3.34.D01.1.454.heavy.3.raw

SEQ ID NO: 465050 - DNA, 530 bp, Homo sapiens
  misc_feature: HEFZJCU01CBP17.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaaccaggtggtccttacaatgaccaccatggaccctgtggacacagccacatatttctgtgcacactctataggagcacctgtagtctgccaaactgttcgaccctgggcccgggaaccctggtcaccgtctcctcagcctccaccaagggcccatcggtcttcccctc

SEQ ID NO: 465051 - DNA, 525 bp, Homo sapiens
  misc_feature: HEFZJCU01AEYUF.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaataacgaacacagttaatctgagctgacagcctgtcatctgaggacacgggcttctacttctgtgcgaggagtaattactataacactgctccttttacacctccctgacttctggggccatggaaccccggtccg

SEQ ID NO: 465052 - DNA, 515 bp, Homo sapiens
  misc_feature: HEFZJCU01BT42Z.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaatgaacaatctgagagtcgacgatacggctgtctatcattgtgttttcgtatgccttcggttccgcggggacttcgtggggccagggtaacccg

SEQ ID NO: 465053 - DNA, 498 bp, Homo sapiens
  misc_feature: HEFZJCU01BGSS1.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaatccctccaccggcacagcctacatggagctgagcagtctgacacctgacgacacggccgtctattactgtgcgagagccgcgaatatgtggtgcaaagatggtcgttgtttgtttggccggtgaactactggggccagggcaccctggtcaccgtctcctcagcttccaccaagggcccatccggtcttcccctggccgccctgctccaggagcacctcgtggggcacagcggcctgggctgccgtgtcaagg

SEQ ID NO: 465054 - DNA, 538 bp, Homo sapiens
  misc_feature: HEFZJCU01EOF42.40.45.E01.1.454.heavy.3.raw
tctagcgactcacgaccggtgctcgatttagtgagtcagtaagggaaagggggatctcatgtgcaagaaaatgaagcacctgtggttcttcctcctgctggtggcggctcccagatgggtcctgtccctgatgcaggtgcgggagtcgggcccaggactggtgaagccttcggggaccctgtccctcaactgctttgtctctggcaccaccatcaggggtagcagtttctattgggcctgggtccgccaggccccaggcaaggggctggagtggattgggaatgtccatgctcttgggcgctcctactacaacccggccctcaagagtcgagtcctcatttccatagacacggccaacaaccagttttccctgacgctgaggtctgtgaccgccgcagacacggctttatattactgtgcgagactcggcttttgtagtggtggtagctgcaatccgggttactactccaacttcggtttggacatctggggccaaggggacctcggtcgtcgtttcctcagcctccaccaagggccc

SEQ ID NO: 465055 - DNA, 489 bp, Homo sapiens
  misc_feature: HEFZJCU01CI2LV.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgccctgctccaggagcacctccgagacgcacagcggccctgggctgcctggtcaggactacttcccatactcgta

SEQ ID NO: 465056 - DNA, 504 bp, Homo sapiens; identical to SEQ ID NO: 445222
  misc_feature: HEFZJCU01CR4KI.9.33.C11.1.454.heavy.3.raw

SEQ ID NO: 465057 - DNA, 508 bp, Homo sapiens
  misc_feature: HEFZJCU01CWUQ7.22.86.H09.1.454.heavy.3.raw
  modified_base (498)..(498): a, c, t, g, unknown or other
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacgggcagtgtattactgtgcgagagatcgacatgactacgggaaagcttttgatctctggggccaagggacactggtcaccgtctcttcagcctccaccaagggcccatcggtcttcccctgccgccctnctccaggacg

SEQ ID NO: 465058 - DNA, 509 bp, Homo sapiens
  misc_feature: HEFZJCU01E0K53.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctctcagcttccaccaaggcccatcggtcttcccctggcgcctgctccaggagcacctctgggggcacgagcggccctgggctgcctggtcaaggactactttcccat

SEQ ID NO: 465059 - DNA, 507 bp, Homo sapiens
  misc_feature: HEFZJCU01ED6IZ.49.55.E11.1.454.heavy.3.raw
agtcgagagacacgaccggtgctcgatttagcactcgcacgttgggtttgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctggggccagggagccctggtcaccgtctcctcagcttccaccaagggcccatcggtcttccccctggccgccctgctccaggagcacctctgggggcacagcggccctgggctgcctggtcaggactacttcctctctcg

SEQ ID NO: 465060 - DNA, 520 bp, Homo sapiens
  misc_feature: HEFZJCU01D72ZH.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaaactcctactacggtctggacgtctggggccaggggacctaac

SEQ ID NO: 465061 - DNA, 504 bp, Homo sapiens
  misc_feature: HEFZJCU01DDF4R.52.2.A02.1.454.heavy.3.raw
cgcagtacgacacgaccggtgctcgatttagactcatctacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaggtggtggagtctgggggaggcgtggtccagcctgggaggtccctgagactctcctgtgcagcctctggattcaccttcagggtctatgacatgcacgtgggtccgccaggctccaggcaaggggctggagtgggtggcagttatatcatatgatggaagtaaatatactatgtagactccgtgaagggccgattcatcatctccagagacattccgagaacaccctgtatctgcaaatgaacagcctgagagctgaggacacggctgtgtattactgtgacgaacttaatcgaggaggacaacgggtccggccccgtcc

SEQ ID NO: 465062 - DNA, 504 bp, Homo sapiens
  misc_feature: HEFZJCU01D59JO.10.38.D05.1.454.heavy.3.raw
  modified_base (443)..(443): a, c, t, g, unknown or other
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttcccctggcgccctgctccnggagcacctccgagagcacagcggccctgggctgcctgtcaaggactacttcccactacta

SEQ ID NO: 465063 - DNA, 505 bp, Homo sapiens
  misc_feature: HEFZJCU01B86DC.52.86.H09.1.454.heavy.3.raw
cgcagtacgacacgaccggtgctcgatttagtgctatagacttgggtttggggggggcgtggtccaggctgggaggtccctgagactctcctgtgcagcctctggattcaccttcagtacccatgaaatgcactggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttcccctggcaccctcctccaagagcacctctgggggcacagcggccctgggctgcctggtcaaggactacttcct

SEQ ID NO: 465064 - DNA, 520 bp, Homo sapiens
  misc_feature: HEFZJCU01C921L.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctgggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggttctacttcgatctctc

SEQ ID NO: 465065 - DNA, 400 bp, Homo sapiens; identical to SEQ ID NO: 444452
  misc_feature: HEFZJCU01ESD3E.47.24.C02.1.454.heavy.3.raw

SEQ ID NO: 465066 - DNA, 441 bp, Homo sapiens; identical to SEQ ID NO: 447294
  misc_feature: HEFZJCU01AP0P8.48.20.B09.1.454.heavy.3.raw

SEQ ID NO: 465067 - DNA, 517 bp, Homo sapiens
  misc_feature: HEFZJCU01CRSZF.26.12.B01.1.454.heavy.3.raw
agactatactcacgaccggtgctcgatttagtagtgtagattccgcgggggggagaggagccccagccctgagactcccaggtgcttccattcagtgatcagcactgaacacagaggactcaccatggagttgggactgaactggattttccttttgaccattttaaaaggtgtccagtgtgaagggcagctggtggagtctgggggagacttggtccagcctggcaagtccctaagactctcctgtgtcgcttctggattcacctttgatgaatatgccatgcactgggtccgtcaggcaccagggaggggcctggagtgggtctcaggtatcagttacaatagtggtaatatactctatgcggactctgtgaagggccgattcaccatctccagagacaacgccaggaactccctctatctagaaatggacagtctgacaactgaggacacggccttttatttctgtgcaaaggtggaaccgacatatttcaactaagctggcactggtacttcg

SEQ ID NO: 465068 - DNA, 489 bp, Homo sapiens
  misc_feature: HEFZJCU01CJPTI.51.1.A01.1.454.heavy.3.raw
cgatcgtatacacgaccggtgctcgatttagacgtctcatcaggggtgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcatatgatggaagtaatatatactatgtagactccgtgaagggccgattcatcatctccagagacaattccgagaacacgctgtatctgcaaatgaacagcctgagagttgaggacacggctgtgtattattgtgcgaacttaatcacggaggacaac

SEQ ID NO: 465069 - DNA, 497 bp, Homo sapiens
  misc_feature: HEFZJCU01EBUIW.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctgggtcaccggtctcctcagcctccaccaagggcccatcgtcttcccctggcaccctcctccacgagcacctctgggggcacagcggccctgggctgcctggtcaaggactacttccgagtagtaca

SEQ ID NO: 465070 - DNA, 517 bp, Homo sapiens; identical to SEQ ID NO: 446891
  misc_feature: HEFZJCU01EVXHZ.17.33.C11.1.454.heavy.3.raw

SEQ ID NO: 465071 - DNA, 508 bp, Homo sapiens
  misc_feature: HEFZJCU01BO1RT.48.52.E08.1.454.heavy.3.raw
agtatacatacacgaccggtgctcgatttagtcgagctctcagagaggtgccttagccctggattccaaggcatttccacctggtgatcagcactgaacacagaggactcaccatggaggtggggctgtgctgggtgttccttgttgctattttagaaggtgtccaatgtgaggtgcagctggtggaatctgggggtgccttggtgccggccgggggggtccctgagactctcctgtgtagcctccggattcacatttagttcccatagtatggtctgggtccgccaggctccagggaagggtctagagtggatttcatacattaggagtggcagtagtcccatatactacgcagactctgtgaagggccgattcatcatctccagagacaatgccgagaactcactgtttctgcaaatgaacagcctgagagacgaggacacggctgtttattactgtgcgagagtgcggatttcgacctacacagggctgggtttccgaccccgtc

SEQ ID NO: 465072 - DNA, 513 bp, Homo sapiens
  misc_feature: HEFZJCU01BW1X4.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaaccctggtcgccgtctcctcagcctccaccaaggcccatcggtcttcccctgcaccctcctccaagagcacctctgggggcacagcggcctggctgcctggtcaaggactacttccagacgtatca

SEQ ID NO: 465073 - DNA, 533 bp, Homo sapiens
  misc_feature: HEFZJCU01EWFFM.53.68.G02.1.454.heavy.3.raw
cgcgtatacacacgaccggtgctcgatttagtcgatagtgaagggaaaggggcacaagaacatgaaacacctgtggttcttcctcctcctggtggcagctcccagatgggtcctgtcccaggtgcagctgcagcagtggggctcaggactgttgaagccttcggagaccctgtccctcacgtgcgctgtctatggtgggtcattcagtgattattattggacctggatccgccaggccccagggaaggggctggagtggatagcggaaatcaatcatagtggaaagactacctacaacccgtccctcaagagtcgagtcaccttatcggtagacacgcccaagaagcagttctccctgagggtgacgtctgtgaccgccgcggacacggctgtctattactgtgcgagaggccccttagtttcggtttttggactggttctcccatggaatccctactttgagtactggggccgcggagccctggtcaccgtctcctcagcctccaccaaggcccatcggtcttccccctcgg

SEQ ID NO: 465074 - DNA, 414 bp, Homo sapiens; identical to SEQ ID NO: 453362
  misc_feature: HEFZJCU01CJX2S.40.81.H04.1.454.heavy.3.raw

SEQ ID NO: 465075 - DNA, 521 bp, Homo sapiens
  misc_feature: HEFZJCU01EOH1O.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatgtattactgtactaaatcgcgggtggccgcggccggtacctcggatggttttgatttctggggccaagggacaatggtcaccgtctcttcagcctccaccaagggcccatcggtcttccccctcggcaccctcctccaagagcacctctgggggcacagcggccctcgggctgcctggtcaaggactacttccgagtagtaca

SEQ ID NO: 465076 - DNA, 505 bp, Homo sapiens
  misc_feature: HEFZJCU01EPQB9.26.80.H03.1.454.heavy.3.raw
agactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaagtgaagaagcctggggcctcagtgaaggtctcctgcaaggcttctggatacaccttcaccgcctactatatccactgggtgcggcaggcccctggacaagggcttgagtggatgggacacatcagccctaacactggtgacacaaactatgcacagagatttcagggcagggtcaccatgaccacggacacgtccataagcacagtttacatggaggtaaataaggctgagatctgacgacacggccgtatattactgtgcgttattaacggacgattacgatgttttgatttggtttttacg

SEQ ID NO: 465077 - DNA, 479 bp, Homo sapiens; identical to SEQ ID NO: 447128
  misc_feature: HEFZJCU01EWRTP.4.37.D04.1.454.heavy.3.raw

SEQ ID NO: 465078 - DNA, 522 bp, Homo sapiens
  misc_feature: HEFZJCU01AUYHL.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacggaacgttactacgctatggacgtctggggccaaggggacccg

SEQ ID NO: 465079 - DNA, 520 bp, Homo sapiens
  misc_feature: HEFZJCU01A0MJ5.16.35.D02.1.454.heavy.3.raw
tgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaagcccggggagtctctgaggatctcctgtaagggttctggatacaggttttccagctactggatcacctgggtgcgccagaagcccggtaaaggcctggagtggatggggaggattgatcccagtgactctcacatcaactacagcccgtccttccaaggccacgtcaccatctcagctgacaagtccatcagtactgccttcctgcagtggcgcagcctggaggcctcggacaccgccatatattactgtgcgagtccggttatcgccgcagatcactactacctactacggtctggacgtcgtggggccaagggaccg

SEQ ID NO: 465080 - DNA, 510 bp, Homo sapiens
  misc_feature: HEFZJCU01ESAVQ.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccgggtgacgcctacggcaggcggtccttttgactttcgtc

SEQ ID NO: 465081 - DNA, 503 bp, Homo sapiens; identical to SEQ ID NO: 445995
  misc_feature: HEFZJCU01E0ZYJ.17.25.C03.1.454.heavy.3.raw

SEQ ID NO: 465082 - DNA, 490 bp, Homo sapiens
  misc_feature: HEFZJCU01D29QI.52.53.E09.1.454.heavy.3.raw
cgcagtacgacacgaccggtgctcgatttagagagagtgtgttgggtttgggggaggcttggtccagcctggtggttccctgagactctcctgtgcagcctctggatttccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcggagcagccccgtaacttctggggccagggaacccggtcaccgtctcctcagcctccaccaagggcccatcggtcttcccctggcaccctcctccaagagcacctctgggggcacagcggccctggctgcctggtcaaggactacttcctatacgatcg

SEQ ID NO: 465083 - DNA, 511 bp, Homo sapiens
  misc_feature: HEFZJCU01CZ4SA.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcactccgagagcacagcggccctggg

SEQ ID NO: 465084 - DNA, 507 bp, Homo sapiens
  misc_feature: HEFZJCU01DF2DB.9.78.H01.1.454.heavy.3.raw
tgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctgggctgcctggtcaggactacttccagacgtatca

SEQ ID NO: 465085 - DNA, 483 bp, Homo sapiens; identical to SEQ ID NO: 444639
  misc_feature: HEFZJCU01CK7IF.11.23.C01.1.454.heavy.3.raw

SEQ ID NO: 465086 - DNA, 506 bp, Homo sapiens
  misc_feature: HEFZJCU01CMRM2.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgacggagcctgacatctgacgacacggccgtctattactgtgcgagagtcccacgatccggtgagcctacggcagcggcctttgacctttgtc

SEQ ID NO: 465087 - DNA, 531 bp, Homo sapiens; identical to SEQ ID NO: 446857
  misc_feature: HEFZJCU01AHYS7.7.78.H01.1.454.heavy.3.raw

SEQ ID NO: 465088 - DNA, 509 bp, Homo sapiens; identical to SEQ ID NO: 456109
  misc_feature: HEFZJCU01B4IYT.17.25.C03.1.454.heavy.3.raw

SEQ ID NO: 465089 - DNA, 373 bp, Homo sapiens; identical to SEQ ID NO: 445532
  misc_feature: HEFZJCU01AXJZH.7.37.D04.1.454.heavy.3.raw

SEQ ID NO: 465090 - DNA, 517 bp, Homo sapiens
  misc_feature: HEFZJCU01C1O9H.13.23.C01.1.454.heavy.3.raw
tcacgtactacacgaccggtgctcgatttagtacacgtgattagggattgggggaggcgtggtccagcctggggaatccctgacactgtcttgtgtagcctctggattcagcttcagaacctatggcatgcactgggtccgccaggccccaggcaaggggctggagtggctgactcttttatcatatgatggaagtcaaaaattctatgcagactccgtgaagggccgattcaccgtctccagggacaactccaagaacaccttatatctgcagatgaacagcctgagaggtgacgactcggctgtatacttctgtgcgacaaacatgatgtttggagtggatgtgtacttctaccactacggaatggacgtctgggccaagggaccgcggtcaccgtctcctcagcctccaccaagggcccatcggtcttccccctggccaccctcctccaacgagcacctctgggggcacagcggccctgggctgcctggtcaaggactacttcctagtacgtga

SEQ ID NO: 465091 - DNA, 514 bp, Homo sapiens
  misc_feature: HEFZJCU01DD9NX.48.28.C06.1.454.heavy.3.raw
agtatacatacacgaccggtgctcgatttagagctcacgtattgggtttggggcgtgagctgggttttccttgttgccatattagaaggtgtccactgtgaggtgcagctggcggagtctgggggagacttggtacagcctggggagtccctgagactctcctgtgcagcctctggattcaccttcagtttgtttgacatgcactgggtccgccaggctccaggaaaaggtctggagtgggtctcagtcatgggtacagctggtcacacatactatgcagactccgtaaagggccgattcaccatctccagagaagacgccaagaattccttgtatcttcagatgaacagtctgagaaccgatgacacggctgtgtattattgtgcaaaaggggggagcagctcgtccatccacttcgactcctgggccagggaaccctggtcaccgtctcctcagcctccaccaagggcccatcggtcttccccctggccaccctcctccaagagcacctctc

SEQ ID NO: 465092 - DNA, 526 bp, Homo sapiens
  misc_feature: HEFZJCU01A8255.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctccttgacttctgggccatggaacccggtccg

SEQ ID NO: 465093 - DNA, 514 bp, Homo sapiens
  misc_feature: HEFZJCU01DSBSR.48.35.D02.1.454.heavy.3.raw
agtatacatacacgaccggtgctcgatttagcacacgatagttgggtttgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagccgcagtggtctttttgtatgtcctttgtatatggtggggccgaagggacaagtggtcgaccgtt

SEQ ID NO: 465094 - DNA, 513 bp, Homo sapiens
  misc_feature: HEFZJCU01CMOX3.4.30.C08.1.454.heavy.3.raw
agcactgtagcacgaccggtgctcgatttagtctgacgtcaaagggaaaggggctcagagaggagccttagccctggactccaaggcctttccacttggtgatcagcactgagcacagaggactcaccatggaattggggctgagctgggttttccttgttgctattttagaaggtgtccagtgcgaggtgcagctggtggagtctgggggaggcttggtccagcctggggggtccctgagactctcctgtgcagcctctggattcacctttactacctattggatggactgggtccgccaggctccagggaaggggctggagtgggtggccaacataaaccaagatggaagtgaacagtactatgtggactctgtgaagggccgattcaccatctccagagacaacgccaagaactcactgtatctgcaaatgaacagcctgagagccgaggacacgggctattttattactgtgtgaaagagaactggttcttcgatctctggggccgtgg

SEQ ID NO: 465095 - DNA, 536 bp, Homo sapiens
  misc_feature: HEFZJCU01B3ACN.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttggaggggcctttcatgtctggggccaagggacgctggtcaccgtctcttcagcctccaccaagggcccatcggtcttcccctggcaccctcctccaagagcacctctgggggcacagcc

SEQ ID NO: 465096 - DNA, 495 bp, Homo sapiens
  misc_feature: HEFZJCU01DHAY1.48.57.F02.1.454.heavy.3.raw
agtatacatacacgaccggtgctcgatttagctcgatatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaagtgcagctggtggagtctgggggaggcttggtccagcctggggggtccctaagactctcctgtgcagcctctggattcacctttagtacctattggatgacctgggtccgccaatctccagggggggggctggagtgggtggccgaatataaaggagatggaagtgtgacacactatgtggactctgtgaagggccgattcaccatctccagagacaatgccaaggagtcactgtatctgcagatgaacagcctgagagccgaggacgcggctgtgtattactgtgcgagagatgcgaatcct

SEQ ID NO: 465097 - DNA, 512 bp, Homo sapiens
  misc_feature: HEFZJCU01EZBN8.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagaccgctacgtgggggcccgggagcccctggt

SEQ ID NO: 465098 - DNA, 498 bp, Homo sapiens
  misc_feature: HEFZJCU01EY7SW.49.38.D05.1.454.heavy.3.raw
agtcgagagacacgaccggtgctcgatttagtatctgatagttgggtttggggggaagaggaagactgacggtcctcccaggagttcaggtgctgggcaccgtgggcatgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctgggccagggagcctggtcaccgtctcctcagcttccaccaggcccatcgtcttcccctggccgcctgctc

SEQ ID NO: 465099 - DNA, 505 bp, Homo sapiens; identical to SEQ ID NO: 446616
  misc_feature: HEFZJCU01D4TSB.51.65.F10.1.454.heavy.3.raw

SEQ ID NO: 465100 - DNA, 489 bp, Homo sapiens; identical to SEQ ID NO: 444791
  misc_feature: HEFZJCU01DMLXW.47.85.H08.1.454.heavy.3.raw

SEQ ID NO: 465101 - DNA, 484 bp, Homo sapiens
  misc_feature: HEFZJCU01EDSLV.17.36.D03.1.454.heavy.3.raw
cgtagactagcacgaccggtgctcgatttagctgcgtcacgatctctcttggggctcagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtaccgcctgggggtccctgagactctcctgtagagcctctggattcgccttcagtacctacagcatgaactgggtccgccaggttccagggaagggtctggagtgggttgcatacattagtagtagtgatagttccatatactacgcagactctgtgaagggccgattcaccatctccagagacagtgccaagaactcactgtatctgcaatgaacagccttagagacgacgacacggctgtgtattactgtgcgagagatccg

SEQ ID NO: 465102 - DNA, 510 bp, Homo sapiens; identical to SEQ ID NO: 448291
  misc_feature: HEFZJCU01BHRDS.8.37.D04.1.454.heavy.3.raw

SEQ ID NO: 465103 - DNA, 536 bp, Homo sapiens
  misc_feature: HEFZJCU01B4BCT.11.10.A10.1.454.heavy.3.raw
cgagagataccacgaccggtgctcgatttagcgtcgatctcaggggctgtcgtgatgattgcgtggtgggactctgtcccgctccaaggcacccgctctctgggacgggtgccccccggggtttttggactcctgggggtgacttagcagccgtctgcttgcagttggacttcccaggccgacagtggtctggcttctgaggggtcaggccagaatgtggggtacgtgggaggccagcagagggttccatgagaagggcaggacagggccacggacagtcagcttccatgtgacgcccggagacagaaggtctctgggtggctgggtttttgtggggtgaggatggacattctgccattgtgattactactactactactacatggacgtctggggcaaagggaccacggtcaccgtctcctcagcctccaccaagggcccatccggtcttccccctcggcaccctcctccaagagcacctctgggggcacagcggccctgggctgcctggtcaaggactacttccgtatctctcg

SEQ ID NO: 465104 - DNA, 507 bp, Homo sapiens; identical to SEQ ID NO: 450403
  misc_feature: HEFZJCU01EXJIY.11.72.G06.1.454.heavy.3.raw

SEQ ID NO: 465105 - DNA, 403 bp, Homo sapiens; identical to SEQ ID NO: 444540
  misc_feature: HEFZJCU01CZ3G1.16.72.G06.1.454.heavy.3.raw

SEQ ID NO: 465106 - DNA, 513 bp, Homo sapiens
  misc_feature: HEFZJCU01C5KX9.51.30.C08.1.454.heavy.3.raw
cgatcgtatacacgaccggtgctcgatttagtctgacgtcaaagggaaaggggaggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagttgctgggaaggacatactacaggtccaagtggtttaatgattatgcagtatctgtgaaaagtcgaataaccatcaacccagacacatccaagaaccagttctccctgcaactgaactctgtgactcccgaggacacggccgtgtattactgtgcaagaggttggttaacagctggaggatttgactactggggccagggaaccctggtcaccgtctcctcagcctccaccaagggcccatcggtcttcccctggcgccctgctccaggagcacctccgagagcacagcggcccgtcgggtcg

SEQ ID NO: 465107 - DNA, 511 bp, Homo sapiens
  misc_feature: HEFZJCU01BKF42.51.81.H04.1.454.heavy.3.raw
cgatcgtatacacgaccggtgctcgatttagtagtgtagattcgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcagggtcatcatgaccggggacacgtccatcgccacaacttacatggaactgaccagtctgacatttgacgacacggccgtctattactgtgcgacagaagacggcggacagaggttcgcttactggttcgaggctctcccccacg

SEQ ID NO: 465108 - DNA, 504 bp, Homo sapiens
  misc_feature: HEFZJCU01B2IQ2.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgttcatctgaaggaagtgttcaatactatacagactccgtgaagggccgattcaccatctcagagacaattccaagaacacgatgtatctgcaaatggacagcctaagagttgaggacacggctgtttattactgtacgaagagggggatacagtggcagctccaagtacttacg

SEQ ID NO: 465109 - DNA, 389 bp, Homo sapiens
  misc_feature: HEFZJCU01D8CKJ.48.45.E01.1.454.heavy.3.raw
agtatacatacacgaccggtgctcgatttagtgagtcagtaagggaaaggggctggagtgggttggccgtgttaaaaccaaagctgagggtgggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactgactattggggccagggaaccctggtcaccgtctcctcagcctccaccaagggcccatcggtcttcccctggcgccctgctccaggagcacctccgagagcacagcggccctgggctgcctggtcaaggactacttcctatgtatact

SEQ ID NO: 465110 - DNA, 511 bp, Homo sapiens
  misc_feature: HEFZJCU01CF9HN.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggcaccctcctccaagagcacctctgggggcacagccggccctggctgcctggtcaaggctacttccgagtgcgtct

SEQ ID NO: 465111 - DNA, 526 bp, Homo sapiens
  misc_feature: HEFZJCU01BYZBT.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttatactgtgcgagagggacggactacggtgactactgggggttcgacccctgggggccagggaaccctggtcaccgtctcctcagcctccaccg

SEQ ID NO: 465112 - DNA, 520 bp, Homo sapiens
  misc_feature: HEFZJCU01A9H5N.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccaaggggaccg

SEQ ID NO: 465113 - DNA, 537 bp, Homo sapiens
  misc_feature: HEFZJCU01DOK8H.40.70.G04.1.454.heavy.3.raw
tctagcgactcacgaccggtgctcgatttagtgtagtgtgaagggaaaggggggatctcatgtgcaagaaaatgaagcacctgtggtccttcctcctgctggtggcggctcccagatgggtcctgtcccagctgcagctgcaggagtcgggcccaggactggtgaagccttcggagaccctgtccctcacctgcactgtctctggtgcctccatcagcagtactagttactactggggctggatccgccagtccccagggaagggactggagtggattgcggctatttcttatagtgagaacacctactacaacccgtccctcaagagtcgagtcaccatatccgtagacacgtccaacaaccagttctccctgaacctgagccctgtgaccgtcgcagacacggctgtatattattgtgggagacgctttcgtgacttaggccctgactacggtggcccccataccgaggacgatttcctcggtatggacgtctggggccaagggaccacggttaccgtctccctcacgcctcccg

SEQ ID NO: 465114 - DNA, 517 bp, Homo sapiens
  misc_feature: HEFZJCU01B9KVS.53.68.G02.1.454.heavy.3.raw
cgcgtatacacacgaccggtgctcgatttagtcgatagtgaagggaaagggtggagtctgggggagacttgatacagcctggcaggtccctgagactctcctgtgcagcctctggattcacgtttgatgattctgtcatgcactgggtccggcaaactccagggaagggcctggagtggctctcaggcattacttggaatagtggcagtacaggttatgcggactctgtgaagggccgattcaccatctccagagacaacagcaaggagctcctttatttacaaatggacagcctgagagttgaggacacggccgtatattactgtgtgaaagacagcggcccacctcgcagttggtattactattacgggatggacatctgggccgagggaccacggtcaccgtctcctcagcctccaccaacgggcccatccggtcttcccctggccgccctgctccaggagcacctccgacgagcacacgccggccctgggctgcctggtcaaggactacttcc

SEQ ID NO: 465115 - DNA, 521 bp, Homo sapiens
  misc_feature: HEFZJCU01EOWXT.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactggggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttccccctggcaccctcctccaagagcacctctgggggcacagcggccctgggctgcctggtcaaggactacttcctagagacacg

SEQ ID NO: 465116 - DNA, 528 bp, Homo sapiens
  misc_feature: HEFZJCU01CDGFO.48.56.F01.1.454.heavy.3.raw
agtatacatacacgaccggtgctcgatttagcagacgtctgaacacacaaaggggtctgagagaagagcccagccctgggattttcaggtgttttcatttggtgatcaggactgaacagagagaactcaccatggagtttgggctgaggtggctttttcttgtggcgattttaagaggtgtccagtgtgaggtgaagttgttggagtctgggggaggcttggtaaagccggggggctccctgacactctcctgtgtaacctctggcttcgactttaagtcttatgccatgacctgggtccgccaggctccagggaaggggctggagtgggtctcaacaattagtgttagtggtgacgacagatactacgcagactccgtggagggccgcttcaccatctccagagacagccccaagaacacactgtctctggagatgatcaacctgagagccgacgacacggcagtgtattactgcgcgaaagaaatcaaagtgggctcatctcgggcggccgacccactcggggccg

SEQ ID NO: 465117 - DNA, 487 bp, Homo sapiens; identical to SEQ ID NO: 444878
  misc_feature: HEFZJCU01DBR0D.47.85.H08.1.454.heavy.3.raw

SEQ ID NO: 465118 - DNA, 530 bp, Homo sapiens
  misc_feature: HEFZJCU01BO2AW.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgtagagcgtcgtctgtcagtggaattgactactggggccagggaaccctggtcaccgtctcctcagcctccaccaa

SEQ ID NO: 465119 - DNA, 511 bp, Homo sapiens; identical to SEQ ID NO: 446799
  misc_feature: HEFZJCU01EA6NO.18.39.D06.1.454.heavy.3.raw

SEQ ID NO: 465120 - DNA, 512 bp, Homo sapiens; identical to SEQ ID NO: 445688
  misc_feature: HEFZJCU01EHQQD.3.34.D01.1.454.heavy.3.raw

SEQ ID NO: 465121 - DNA, 521 bp, Homo sapiens
  misc_feature: HEFZJCU01B3SVI.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaaggcccatcggtcttcccctcggcg

SEQ ID NO: 465122 - DNA, 491 bp, Homo sapiens; identical to SEQ ID NO: 446104
  misc_feature: HEFZJCU01BREJI.3.34.D01.1.454.heavy.3.raw

SEQ ID NO: 465123 - DNA, 404 bp, Homo sapiens
  misc_feature: HEFZJCU01E156K.3.72.G06.1.454.heavy.3.raw
agacgcactccacgaccggtgctcgatttagctacgactgcaagggaaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgagaggcaggctgtggggcatagtgggtactacctatgcttttgatatctggggccaagggacaatggtcaccgtctcttcagcctccaccaagggcccgatcggtcttccccctggcaccctcctccaagagcacctctgggggcatagcggccctgggctgcctggtcaaggactacttccgagtgcgtct

SEQ ID NO: 465124 - DNA, 379 bp, Homo sapiens; identical to SEQ ID NO: 444450
  misc_feature: HEFZJCU01C17WE.47.77.G11.1.454.heavy.3.raw

SEQ ID NO: 465125 - DNA, 322 bp, Homo sapiens
  misc_feature: HEFZJCU01B9GMF.49.27.C05.1.454.heavy.3.raw
agtcgagagacacgaccggtgctcgatttagacgcgatcgaagggtcttcgtggctcacgtccaccaccacgcatgtgacctcaggggtccgggagatcatgagggtgtccttgggttttggggggaagaggaagactgacggccccccctttcaggagcgatcatactactttgaccactggggccagggaaccctggtcaccgtctcctcagcctccaccaagggcccatcggtcttccccctggcaccctcctccaagagcacctctggggcacagcggccctgggctgcctggtcaaggactacttcctctctcgact

SEQ ID NO: 465126 - DNA, 505 bp, Homo sapiens
  misc_feature: HEFZJCU01C6CEK.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccaggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggacg

SEQ ID NO: 465127 - DNA, 509 bp, Homo sapiens
  misc_feature: HEFZJCU01C0PWQ.52.1.A01.1.454.heavy.3.raw
cgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatgtccctcacctgctctgtctctggtgactccatcagcagtggttattactgggcctgggtccggcagcccccagggaaggggtttgagtggattgggagtatcgatcacagtgggagcacctacctgaacccgtccctcacgactcgagtcgccatatcaacagacacgtccaagaaccagttctacctgaggctgaactctgtgaccgccgcagacacggccgtatattattgtgcgcgggacttcgaggggtggatatagtggctacgattcgtatctccttgactactggggccagggaaccctggtcaccgtct

SEQ ID NO: 465128 - DNA, 506 bp, Homo sapiens; identical to SEQ ID NO: 448223
  misc_feature: HEFZJCU01CKW2K.18.50.E06.1.454.heavy.3.raw

SEQ ID NO: 465129 - DNA, 524 bp, Homo sapiens; identical to SEQ ID NO: 460157
  misc_feature: HEFZJCU01AM5XG.3.82.H05.1.454.heavy.3.raw

SEQ ID NO: 465130 - DNA, 527 bp, Homo sapiens
  misc_feature: HEFZJCU01A7KMU.51.83.H06.1.454.heavy.3.raw
cgatcgtatacacgaccggtgctcgatttagatcacgtgcgtcgcggggcggggggaagaggaagactgacggtcctcccaggagttcaggtgcagctggtggactctgggggaggcgtggtccagcctgggaggtccctgcgactctcctgtgcagcctctggattcagcttcagggctaatactatgttctgggtgcgccaggctccaggcaaggggctggagtgggtggcagtcatctggcctgatggaggtttaacatactatgcggactccgtggagggccgattcaccgtctccagagacaactccaaaaacacgctgtatctccaaatgaacagcctcagatctgaggacacggctatctactactgtgtgaaagaattgggtttcagtggctactttgacttctggggccagggaaccctggtcaccgtctcctcagcttccaccaagggcccatcggtccttcccctggccgccctcgcctccaggagccacctcgtgggggcacgagccggcccgtc

SEQ ID NO: 465131 - DNA, 512 bp, Homo sapiens
  misc_feature: HEFZJCU01CWSAN.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacgaacgttactacgctatggacgtcgtggggcc

SEQ ID NO: 465132 - DNA, 514 bp, Homo sapiens; identical to SEQ ID NO: 449159
  misc_feature: HEFZJCU01CD9QM.9.70.G04.1.454.heavy.3.raw

SEQ ID NO: 465133 - DNA, 384 bp, Homo sapiens; identical to SEQ ID NO: 444454
  misc_feature: HEFZJCU01EIEBQ.11.61.F06.1.454.heavy.3.raw

SEQ ID NO: 465134 - DNA, 522 bp, Homo sapiens; identical to SEQ ID NO: 451196
  misc_feature: HEFZJCU01EIRCB.10.79.H02.1.454.heavy.3.raw

SEQ ID NO: 465135 - DNA, 526 bp, Homo sapiens
  misc_feature: HEFZJCU01B6PO1.12.33.C11.1.454.heavy.3.raw
atacgacgtacacgaccggtgctcgatttagagtgagctcgttgggtttggggggaagaggaagactgacggtccccccaggagttcaggtgctgggcacggtgggcatgtgtgagttttgtcacaagatttgggctcaactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccgaagggaccacggtcatcgtctcctcagcctccaccaagggcccatcggtcttccccctggccaccctccctccaagagcacctctggggcacagcc

SEQ ID NO: 465136 - DNA, 496 bp, Homo sapiens
  misc_feature: HEFZJCU01E0WC2.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcccctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagatttctatagaggtgactacgggggcgtc

SEQ ID NO: 465137 - DNA, 477 bp, Homo sapiens; identical to SEQ ID NO: 460745
  misc_feature: HEFZJCU01DLWND.16.10.A10.1.454.heavy.3.raw

SEQ ID NO: 465138 - DNA, 514 bp, Homo sapiens
  misc_feature: HEFZJCU01AZEQ5.48.57.F02.1.454.heavy.3.raw
agtatacatacacgaccggtgctcgatttagctcgatatagttgggtttggggtctgtgttgggtttggggggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagccgcctgagacctgacgacacggctgtctattactgtgcgagagggcgtccgagtttaacacgtcc

SEQ ID NO: 465139 - DNA, 496 bp, Homo sapiens
  misc_feature: HEFZJCU01E03WB.48.39.D06.1.454.heavy.3.raw
agtatacatacacgaccggtgctcgatttagtgacatctcgcagttctttggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgtatgcctttgatatgtggggccgaagggac

SEQ ID NO: 465140 - DNA, 501 bp, Homo sapiens
  misc_feature: HEFZJCU01DAEC9.51.43.D10.1.454.heavy.3.raw
cgatcgtatacacgaccggtgctcgatttagactagcagtaagggggagcatcacccagcaaccacatctgtcctctagagaatcccctgagagctccgttcctcaccatggactggacctggaggatcctcttcttggtggcagcagccacaggagcccactcccaggtgcagctggtgcagtccgggggtgaagtgaagaagcctggggcctcagtgaaggtctcctgcagggcctctggatacaccttcaccggctattatatccactgggtgcgacaggcccctggacaagggcttgagtggatgggatggatgaagcccaatagtggtgcacaagacagcacagaagtttcagggcagggtcaccatgaccagggagacgtccgtcaggacagcctatatggaggtgaccagcctgagccctgacgacacggccatatattttctgtgcgcgaggaatttcgacttctggaataattacttgggttggaaactacc

SEQ ID NO: 465141 - DNA, 518 bp, Homo sapiens; identical to SEQ ID NO: 444718
  misc_feature: HEFZJCU01D0K85.9.34.D01.1.454.heavy.3.raw

SEQ ID NO: 465142 - DNA, 514 bp, Homo sapiens
  misc_feature: HEFZJCU01DKGPX.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagaccgctacgtgggggcccgggaggcccctgggt

SEQ ID NO: 465143 - DNA, 378 bp, Homo sapiens
  misc_feature: HEFZJCU01EHUDA.47.77.G11.1.454.heavy.3.raw
agctcacgtacacgaccggtgctcgatttagctagtcactcaagggaaagggctggagtgggtctctggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 465144 - DNA, 489 bp, Homo sapiens
  misc_feature: HEFZJCU01CFXD3.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgttattactgtgggagaaatccta

SEQ ID NO: 465145 - DNA, 510 bp, Homo sapiens; identical to SEQ ID NO: 445542
  misc_feature: HEFZJCU01DJMPZ.16.21.B10.1.454.heavy.3.raw

SEQ ID NO: 465146 - DNA, 494 bp, Homo sapiens
  misc_feature: HEFZJCU01C2YT6.49.28.C06.1.454.heavy.3.raw
agtcgagagacacgaccggtgctcgatttagagctcacgtattgggtttggggagtcgtggtagagcctggggggtccctgagactctcctgtgcagcctctggattcatctttgatgattatgccatgcactggatccgtcaagctccggggaagggtctggagtgggtctctcttattaattgggatggtggtatcacctactatgcagactctgtgaagggtcgattcaccatctccagagacaacagcagaaaactccctgtatctgcaaatgaacagtctcagaggtgaggacaccgccttctactactgtgcaaaagattacggtgaccacacctattttgaccactgcggccagggaaccctagtcaccgtctcctcagcctccaccaagggcccatcggtcttcccctggcaccctcctccaagagcacctctgggggcacagcggccctgggctgcctggtcaaggactacttcctctctcgact

SEQ ID NO: 465147 - DNA, 506 bp, Homo sapiens
  misc_feature: HEFZJCU01AD3YA.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgacccctggggccagggaaccctggtcaccgtctcctcagcctccaccaagggcccatcggtcttcccctggcaccctcctccaagagcacctctgggggcacagcggcctgggctgcctggtcaaggactactccgta

SEQ ID NO: 465148 - DNA, 525 bp, Homo sapiens; identical to SEQ ID NO: 447122
  misc_feature: HEFZJCU01BO8MT.14.55.E11.1.454.heavy.3.raw

SEQ ID NO: 465149 - DNA, 538 bp, Homo sapiens
  misc_feature: HEFZJCU01EB1KL.13.64.F09.1.454.heavy.3.raw
tcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccattaaaaccagcagttatcactgggggtggatccggcagcccccggggaaggagctggagtggatggggaggatttattatactggcaatacttacgacaatccgtccctcaagagtcgagtcaccctgtccgtggacacgccgaataaccagttctccctgaaagtgacctctgtgaccgtcgcagacacggccatttattatttgtgtgagatacgacttttggaatggctatgactcgatcgactactggggccctggaatcctggtcaccgtctcctcagcctccaccaagggcccatcggtcttccccctggccaccctt

SEQ ID NO: 465150 - DNA, 503 bp, Homo sapiens
  misc_feature: HEFZJCU01CD9JF.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcaggcggcctttgacttct

SEQ ID NO: 465151 - DNA, 510 bp, Homo sapiens
  misc_feature: HEFZJCU01AEH7M.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgccctgctccaggagcacctctgggggcacagcggccctgggctgcctggtcaaggactactcccata

SEQ ID NO: 465152 - DNA, 505 bp, Homo sapiens
  misc_feature: HEFZJCU01BVFE5.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaaagccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttcccctggcaccctcctccaagagcacctctgggggcacagcggccctgggctgcctggtcaaggactacttcctacgtcgtat

SEQ ID NO: 465153 - DNA, 503 bp, Homo sapiens
  misc_feature: HEFZJCU01BNPSV.10.38.D05.1.454.heavy.3.raw
  modified_base (443)..(443): a, c, t, g, unknown or other
catagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctaganagtcgaacacacggccacctattattgtgcgcgacatgactacgctcaattcgtgggccg

SEQ ID NO: 465154 - DNA, 495 bp, Homo sapiens; identical to SEQ ID NO: 446949
  misc_feature: HEFZJCU01B309N.16.37.D04.1.454.heavy.3.raw

SEQ ID NO: 465155 - DNA, 492 bp, Homo sapiens
  misc_feature: HEFZJCU01EBO9J.51.52.E08.1.454.heavy.3.raw
cgatcgtatacacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagcctggggcctcagtgaaggtctcctgcaagacttctggatacaccttcaccgactactatatgcactgggtgcgacaggcccctggacaagggcttgagtggatgggatggatcgaccctaagaatggtgccacaactatgcacagacttttctagggctgggtcaccatgaccagcgacacatctagcaacacagtctacatggagttgaccagcctgaccgacacggccgtcgtatttttgtgttgagagattttcggacaatccagagacccctgtc

SEQ ID NO: 465156 - DNA, 523 bp, Homo sapiens
  misc_feature: HEFZJCU01BH3TY.10.30.C08.1.454.heavy.3.raw
  modified_base (489)..(489): a, c, t, g, unknown or other
catagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatctgggggagccttggtacagcctggcgggtccctgagactctcctgtacagtctctggattcacctctgatgattatgccatgcactgggtccggcaagctccagggaagggcctggagtgggtctctggaatcacttacaatagtgatttccttaaatatgcggactctgtgagggggcgtttcaccatctccagagacaacgccaggaactccctcctatctacaaatgaacagtctgagacctgaggacacggccttatatttctgtgcaaagatcttgganctggccgtgaccactgggggccaggggaaccctc

SEQ ID NO: 465157 - DNA, 516 bp, Homo sapiens
  misc_feature: HEFZJCU01AFA0H.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccagagcacctctgggggcacagcggcctggctgcctggtcaaggactacttcctagagacacg

SEQ ID NO: 465158 - DNA, 392 bp, Homo sapiens; identical to SEQ ID NO: 444456
  misc_feature: HEFZJCU01ECPKQ.7.60.F05.1.454.heavy.3.raw

SEQ ID NO: 465159 - DNA, 497 bp, Homo sapiens
  misc_feature: HEFZJCU01CY4Y4.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggtgaactactgggccagggcaccctggtcaccgtctcctcagcttccaccaagggcccatcggtcttcccctgcgcctgctccagagcacctctggggcacagcggcctggctgcctgtcaggactactccat

SEQ ID NO: 465160 - DNA, 522 bp, Homo sapiens
  misc_feature: HEFZJCU01ELS2G.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaagcctgatccagccgggggggtccctgagactgtcctgtgtagtctctgggttcagcgtcagtcgcgaccacatgagttggttccgccaggctccagggaaggggctggagtggctcgcacttatttacagtggcgggcactacatactacacagacttcgcgaggggccgattcaccatctccagagacgattccaagaacacgttgtatcttcaaatgaacagcctgacagtcgacgacacggccatgtatttttgtgcgagcgacccggggctcctcaatggctttcatactgggccagggaacctacg

SEQ ID NO: 465161 - DNA, 506 bp, Homo sapiens; identical to SEQ ID NO: 445682
  misc_feature: HEFZJCU01D40QJ.48.44.D11.1.454.heavy.3.raw

SEQ ID NO: 465162 - DNA, 390 bp, Homo sapiens
  misc_feature: HEFZJCU01B0MHQ.7.60.F05.1.454.heavy.3.raw
cgtgtctctacacgaccggtgctcgatttagtacgtcatcagggaaaggggctggagtgggtctcagtgatttatagtagttccagttcatttcacgcagactccgtgaagggccgattcaccatctccagagacatttccaagaacacggtggatcttcagatggacagcctcagagcggaggacacggctgtctattactgtgtgagaggcgccaccgtggggatggaaacgattttcttgtttgtctggggccagggaaccctggtcaccgtctcctcagcctccaccaagggcccatcggtcttcccctggcgccctgctccaggagcacctccgagagcacagcgccctgggctgcctggtcaaggactacttcctagagacacg

SEQ ID NO: 465163 - DNA, 520 bp, Homo sapiens
  misc_feature: HEFZJCU01C4EXU.52.67.G01.1.454.heavy.3.raw
cgcagtacgacacgaccggtgctcgatttagagtatacatattgggtttggggtgggagaggagcccagcactgggattccgaggtgtttccattcagtgatctgcactgaacacagaggactcgccatggagtttgggctgagctgggttttccttgttgctattttaaaaggtgtccagtgtggagtgcaggtggtggagtctgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccgaggggggcgggagcagccccgtaacttcgtggggccac

SEQ ID NO: 465164 - DNA, 419 bp, Homo sapiens; identical to SEQ ID NO: 459293
  misc_feature: HEFZJCU01DQZYW.4.22.B11.1.454.heavy.3.raw

SEQ ID NO: 465165 - DNA, 496 bp, Homo sapiens
  misc_feature: HEFZJCU01EQ5EA.19.59.F04.1.454.heavy.3.raw
tactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtacagcctggagggtccctgagactctcctgtgcagcctctggattcaccttcagtagttatgaaatgaattgggtccgccaggctccagggaaggggctggagtgggtttcatacattagtagtagtgggtagtagcatatactacgcagactctgtgaagggccgattcaccatctccagagacagcgccaagaactcactgtatctgcaaatgaacagcctgagagccgaggacacggcagtttattactgtgcgagagagtggctaa

SEQ ID NO: 465166 - DNA, 512 bp, Homo sapiens
  misc_feature: HEFZJCU01E0LUJ.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggtagctgaacagcctaagtcctgaggacacgggcgtagtactactagtacgaaggaggggggaacgagcgggagtcgaacgtactcctt

SEQ ID NO: 465167 - DNA, 513 bp, Homo sapiens
  misc_feature: HEFZJCU01AULJW.51.12.B01.1.454.heavy.3.raw
cgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcagggtcagtcatgaccggggacacgtccatcgccacaacttacatggaactgaccagtctgacatttgacgacacggccgtctattactgtgcgacagaagcggcggacagaggttcgcttactcggttcgaggctctcccctacg

SEQ ID NO: 465168 - DNA, 510 bp, Homo sapiens
  misc_feature: HEFZJCU01B1LLS.51.36.D03.1.454.heavy.3.raw
cgatcgtatacacgaccggtgctcgatttagctgcgtcacgatctctcttggggggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactactggggctggatccggcagccccccgggaaggggctggattggattggcagtatcagttatactgggaccaccttcttcaagtcgtcgctcaagagtcgagtcaccatgaccgcggacacgtccaaggaccagttctccctgaagctgacctctgtgaccgccgcagacacggctttgtatttctgtgctagatataatgtgggtgacagtggtgcctactacggagtcttttgattagtttggggccaaggcacgaaggtcaccgtctcatcacg

SEQ ID NO: 465169 - DNA, 499 bp, Homo sapiens
  misc_feature: HEFZJCU01BUCYW.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctgggggtggctacgagtactggtacttcgatctctggggccgtggcaccctgctgactgtctcctcagcctccaccaagggcccatcggtcttcccctggcgccctgctccaggagcacctccgagagcacagcggccctgggctgcctggtcaaggactaccg

SEQ ID NO: 465170 - DNA, 463 bp, Homo sapiens; identical to SEQ ID NO: 446208
  misc_feature: HEFZJCU01CJ6UM.19.10.A10.1.454.heavy.3.raw

SEQ ID NO: 465171 - DNA, 526 bp, Homo sapiens
  misc_feature: HEFZJCU01A79ZX.49.71.G05.1.454.heavy.3.raw
agtcgagagacacgaccggtgctcgatttagtgtcgtcgcaagagagagggggctccttcaccacccagcggggatctcacggcttccttttctgtcctcctccaggatggggtcaaccgccatcctcgccctcctcctggctgttctccaaggagtctgtgccgaagtgcagctggtgcagcccggagcggtaatgaaaagcccggggagtctctgaggatctcctgtaagggttctggatacagctttagtaccttctggatcacctgggtgcgccagctgcccgggaaaggcctggaatggatggggaggattgaccccagtgactccagtaccaactacagtccgtccttcgaaggccacgtcagcatctcacttgacgtgtccaccaccactgtctacctacagtggcgcagcctcaagacatcggacaccgccacctacttactgtgcacgacgccgttataccagaggctggtaccttgactcctcggggccagggcaccctggtcaccgtctcctcca

SEQ ID NO: 465172 - DNA, 514 bp, Homo sapiens
  misc_feature: HEFZJCU01ERRTW.16.9.A09.1.454.heavy.3.raw
tgtactactccacgaccggtgctcgatttagcgagacgcgcagggggagagaggggcccagccctgggattttcaggtgttttcatttggtgatcaggactgaacagagagaactcaccatggagtctgggctgagctggcgtttttcttgtggctattttaaaaggtgtccagtgtgaggtgcagctgttggagtctgggggaggcttggcacagcctgggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagtcgaggacacggccgtatattattgtgcgaaagacgtatgtagtggtgactgcttgtttgagcttttgactacg

SEQ ID NO: 465173 - DNA, 522 bp, Homo sapiens
  misc_feature: HEFZJCU01AKBYM.15.28.C06.1.454.heavy.3.raw
tctacgtagccacgaccggtgctcgatttagagctcacgtattgggtttggggggaagaggaagactgaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttggggccagggaaccctggtcaccgtctcctcagcctccaccaac

SEQ ID NO: 465174 - DNA, 503 bp, Homo sapiens; identical to SEQ ID NO: 445995
  misc_feature: HEFZJCU01DE434.17.25.C03.1.454.heavy.3.raw

SEQ ID NO: 465175 - DNA, 493 bp, Homo sapiens
  misc_feature: HEFZJCU01B5NGV.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcggatattgt

SEQ ID NO: 465176 - DNA, 515 bp, Homo sapiens; identical to SEQ ID NO: 460635
  misc_feature: HEFZJCU01CI3GX.46.67.G01.1.454.heavy.3.raw

SEQ ID NO: 465177 - DNA, 518 bp, Homo sapiens
  misc_feature: HEFZJCU01BYMMJ.13.61.F06.1.454.heavy.3.raw
tcacgtactacacgaccggtgctcgatttagctacgctctaagggaaagggggaggcttggtccagccgggggggtcactgagactctcctgtacagcctcgagattcattttcaggaattattggatgagttgggtccgccagtctccagggaaggggctggagtgggtggccaacataaaaggaggatgggagtcagacatattatgtggagtctgtgcggggccgattcaccatttccagagacaacgccagatcgtcagtatatctgcaaatgaggagcctgagagtcgatgatacggctacatattattgtgcgagaattgacagttttccagacggcgactacgttgtcggctggggcgactttgacatttggggccaagggacactggtcaccgtctcccaagcttccaccaagggcccatcggtcttcccctggcgccctgctccaggagcacctctgggggcacagcggccctgggctgcctggtcaaggactacttccgtactagacg

SEQ ID NO: 465178 - DNA, 528 bp, Homo sapiens
  misc_feature: HEFZJCU01CY76D.17.26.C04.1.454.heavy.3.raw
cgtagactagcacgaccggtgctcgatttagtctagcgactttgggtttggggaagtagtcctgtcccagctgcagctgcaggagtcgggcccaggactggtgaagccttcggagaccctgtccctcacctgcactgtcactggtgactccatcagcagtagtagttactactggggctgcatccgccagcccccagggaaggggctggagcggattgggagtatccattatagtgggagcacccactacaacccgtccctcaagagtcgaatcaccatgtccgtagacacgtccaagaaccggttctccctgaaactgagctctgtgaccgccgcagacacggctgtgtattactgcatagcaatagcacagtacggaatggacgtctggggccaagggaccacggtcaccgtctccctggcctccaccaagggcccatcggtcttccccctggcaccctcctccaagagcacctctgggggcacagcgccctgggctgcctggtcaggactacttcctagtctacg

SEQ ID NO: 465179 - DNA, 518 bp, Homo sapiens
  misc_feature: HEFZJCU01CU3RX.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgtggctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttacacgctatggacgtctggggccaagggaccg

SEQ ID NO: 465180 - DNA, 491 bp, Homo sapiens; identical to SEQ ID NO: 444803
  misc_feature: HEFZJCU01CDG26.4.57.F02.1.454.heavy.3.raw

SEQ ID NO: 465181 - DNA, 517 bp, Homo sapiens
  misc_feature: HEFZJCU01BXE3U.14.66.F11.1.454.heavy.3.raw
cgtctagtaccacgaccggtgctcgatttagtcacgcgagaagggtgccagggggaagaccgatgggcccaggactggtgaagccttcggagaccctgtccctcacctgcactgtctctggcggctccatcaatacttacaactggacctggatccggcagccccccagggaagggtctgaattggattgggtatatctctaacagtgggaggaccaactacaacccctccctccagagtcgagtcaccatttcattagacacgtccaagaaccagttctccctgaggttgaactctgtgaccgctgcggacacggccgtgtattattgtgcgagggtcggtggccacaatggcgagtacaactggttcgacccctggggccagggaaccctggtcaccgtctcctcagcctccaccaagggcccatcggtcttccccctggcaccctcctccaagagcacctctgggggcacagcggccctcgggctgcctggtcaggactactccgtactagacg

SEQ ID NO: 465182 - DNA, 395 bp, Homo sapiens; identical to SEQ ID NO: 448398
  misc_feature: HEFZJCU01DJKUE.47.46.E02.1.454.heavy.3.raw

SEQ ID NO: 465183 - DNA, 512 bp, Homo sapiens; identical to SEQ ID NO: 450914
  misc_feature: HEFZJCU01EJPWZ.15.67.G01.1.454.heavy.3.raw

SEQ ID NO: 465184 - DNA, 392 bp, Homo sapiens; identical to SEQ ID NO: 444456
  misc_feature: HEFZJCU01DE2TD.7.60.F05.1.454.heavy.3.raw

SEQ ID NO: 465185 - DNA, 501 bp, Homo sapiens
  misc_feature: HEFZJCU01DO5M1.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttccccttggcgccctgctccaggagcacctccgagagcacagcggccctgggctgcctggtcaaggactacttccga

SEQ ID NO: 465186 - DNA, 503 bp, Homo sapiens
  misc_feature: HEFZJCU01EUPDP.13.87.H10.1.454.heavy.3.raw
tcacgtactacacgaccggtgctcgatttagcagtactgcgttgggtttggggagctctgggagaggagccccagccccgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggcgattcaccatctccagagacaacgccaagaactccctgtatctgcaaatgaacagcctgagagctgaggacacggccttgtattattgtgcaaaagatccaaccctacgtatttt

SEQ ID NO: 465187 - DNA, 512 bp, Homo sapiens; identical to SEQ ID NO: 445688
  misc_feature: HEFZJCU01A0UE3.3.34.D01.1.454.heavy.3.raw

SEQ ID NO: 465188 - DNA, 503 bp, Homo sapiens
  misc_feature: HEFZJCU01DHVED.10.34.D01.1.454.heavy.3.raw
catagtagtgcacgaccggtgctcgatttagatcgtctgtgttgggtttggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagcctggggggtcccttagactctcctgtgcagcctctggattcactttcagtaacgcctggatgaactgggtccgccaggctccagggaaggggctggagtgggttggccatattaaaatcaaagctgatggtgggacaacagagcacgctgcacccgtgaaaggcagattcagcatctcaagagatgattcaaaaagtacgctgtatctgaacatgaacagcctgaaaacggaggacacagccgtgtattactgtgccactcaggaccgatatttgtt

SEQ ID NO: 465189 - DNA, 530 bp, Homo sapiens
  misc_feature: HEFZJCU01BIMFA.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactactgggggttcgaccccgtggggccgagggaaccctggtcaccgtctcctcagcctccaacccg

SEQ ID NO: 465190 - DNA, 516 bp, Homo sapiens
  misc_feature: HEFZJCU01DQGGS.4.9.A09.1.454.heavy.3.raw
agcactgtagcacgaccggtgctcgatttagcgagacgcgcagggggagagaggagcccagccctgggattttcaggtgttttcatttggtgatcaggactgaacagagagaactcaccatggagtttgggctgagctggctttttcttgtggctattttaaaaggtgtccagtgtgaggtgcagttggtggagtctgggggaggcttggtacagcctggggggtccctgagactctcctgtacagactctggattcacctttagcagccatgccatgagctgggtccgccaggctccagggaaggggctggagtgggtctcagcaattagtggaggtggtggtggtggtacatactacgcaaactccgtgaggggccgattcaccatcctccagagacaattccaagaacacgttatatctgcaaatgaacagcctgcgagccgacgacacggccgtatattactgtgcgaaatcgtccttagttcgacgaccgagcgtagcaggtggctggtcg

SEQ ID NO: 465191 - DNA, 502 bp, Homo sapiens
  misc_feature: HEFZJCU01A31XD.11.57.F02.1.454.heavy.3.raw
cgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccagccgggggggtccctgagactctcctgtctagtctctggattcgccttcagtgactatgccatgaagtgggtccgccaggctccaggtaaggggctggaatgggatttcatacattagcagtagtggtgcgaccatatactacgcagactctgtgaagggccgattcatcatctccagagacaatggcaacaactcactgtatctggaaatcaacagcctgagagtcgaggacacggctgtatattattgtgcgagagccccctacggtgtaccgg

SEQ ID NO: 465192 - DNA, 527 bp, Homo sapiens
  misc_feature: HEFZJCU01DWY4V.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggccagggaaccctggtgaccgtctcctcagcctccaccaagggcccatcggtcttcccctggcgccctgctccagagcacctccgagagcacacgcggcccgtgggtcg

SEQ ID NO: 465193 - DNA, 437 bp, Homo sapiens
  misc_feature: HEFZJCU01D5T66.40.86.H09.1.454.heavy.3.raw
tctagcgactcacgaccggtgctcgatttagtgctatagacttgggtttggggtgtctctagcaacaatgctgcttggaattggatcaggcagtccccatcgaggggccttgagtggctggggaggacatactacaggtccacgtggaaaacgattatgcagcatctgtgaaaagtcgaataaccatcgacccagacacatccaagaaccagttctccctgcaactgaactctctgactcccgaagacacggctgtctattactgtgcatatggttcggggaggttatccctattggggccagggaaccctggtcaccgtctcctcagcctccaccaagggcccatcggtcttcccctggcgccctgctccaggagcacctccgagagcacagcgggccctgggctgcctggtcaaggactacttccagtcgctaga

SEQ ID NO: 465194 - DNA, 505 bp, Homo sapiens; identical to SEQ ID NO: 451218
  misc_feature: HEFZJCU01AQ3EZ.10.38.D05.1.454.heavy.3.raw

SEQ ID NO: 465195 - DNA, 495 bp, Homo sapiens
  misc_feature: HEFZJCU01EXAGL.51.1.A01.1.454.heavy.3.raw
cgatcgtatacacgaccggtgctcgatttagacgtctcatcagggggggagaggagcccagcactagaagtcggcggtgtttccattcggtgatcagcactgaacacagaggactcaccatggagtttgggctgagcgtgggttttcctcgttgctcttttaagaggtgtccagtgtcaggtgcagctggtggagtctgggggagcgtggtccagcctgggaggtccctgagactctcctgtgcagcctctggattcaccttcagggtctatgacatgcactgggtccgccaggctccaggcaaggggctggagtgggtggcagttatatcatatgatggaagtaatatatactatgtagactccgtgaagggccgattcatcatctccagagacaattccgagaacacgctgtatctgcaaatgaacagcctgaagagttgaggacacggctgtgtattattgtgcgaacttaatcacggaggacaacggtccg

SEQ ID NO: 465196 - DNA, 495 bp, Homo sapiens
  misc_feature: HEFZJCU01DB1RE.10.29.C07.1.454.heavy.3.raw
  modified_base (433)..(433): a, c, t, g, unknown or other
catagtagtgcacgaccggtgctcgatttagagtgctacgaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggaatccccttcagtacctatggcatgcactgggtccgccaggctccaggcaaggggctggagtgggtggcagccatatcgtatgatgtaactaataaatactatgcagactccgtgaagggccgattcaccatctccagagacaatttcaagaacacgctgtttctgcaaatnaacagcctgagagctggaggacacggctgtgttattactgtgcgaaagatatcggcggtgta

SEQ ID NO: 465197 - DNA, 548 bp, Homo sapiens
  misc_feature: HEFZJCU01BE7AD.48.40.D07.1.454.heavy.3.raw
agtatacatacacgaccggtgctcgatttagtgatagagcgtaacaacagagagctcaccatggagttggggctgacctgggttttccttgtggctactttaagaggtgtcctgtgtgaggtgcacctgctggagtccgggggaggcttagttcggccgggggagtccctgagactcgcctgtgtagtgtctggattcaccttcaggaattacgacatggactgggtccgccaagctccagggaaggggctggagtgggtctcaaacgtgaacgttgatggcgggatcacaaaatacgcggactccgtgaaaggccgcttcaccgtctccagagacaacggcgagaatactctgtattttgcagatgagaaaatctgagaggcgaggacaccgcgctttattattgtacaacgtcgttttacttttctaatggtggctcttacgaacgacatgactattggggtcggggaaccctggtcacgtctcctcagcctccaccaagggcccatcggtcttcccctggcaccctcctccaacgagcacctctc

SEQ ID NO: 465198 - DNA, 512 bp, Homo sapiens
  misc_feature: HEFZJCU01B9OGR.49.6.A06.1.454.heavy.3.raw
agtcgagagacacgaccggtgctcgatttagatctactgacaggggagctctgagagaggagcccagccctgggattttcaggtgttttcatttggtgatcaggactgagcagagagaactcaccatggagtttgggctgagctggctttttcttgtggctattttaaaaggtgtccagtgtgaggtgcagctggtggactctgggggaggcttggtacagcctggggggtccctgagactctcctgtgcagcctctggattcacctttagcagttttgccatgggctgggtccgccaggctccagggaaggggctggagtgggtctcaactattagcggtattggtactaccacatactacgcagactccgtgaagggccgcttcaccatctccagagacaattccaagaacatggtgtttctgcaaatgagcagcctgagagccgaggacacggccgtatattactgtgcgaaagttcgcgtgctaggtacatttgactactggggaccg

SEQ ID NO: 465199 - DNA, 430 bp, Homo sapiens
  misc_feature: HEFZJCU01EJXGJ.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagcacagcctaacatgga

SEQ ID NO: 465200 - DNA, 474 bp, Homo sapiens
  misc_feature: HEFZJCU01CC298.4.14.B03.1.454.heavy.3.raw
agcactgtagcacgaccggtgctcgatttagtgtgagtagttccgcggggatcactcaacaaccacatctgtcctctagagaaaaccctgtgagcacagctcctcaccatggactggacctggaggatcctcttcttggtggcagctgctacaagtgcccactcccaggtgcagctggtgcagtctggggctgaggtgaagaagcctggggcctcagtgaaggtctcctgcaagacttctggatacaccttcaccagttatgatatccactgggtgcgacaggcctctggacaagggcttgagtggatgggatggatgaacccaaacactggtgccacaggctatgcacagaggttccagggcagagtcaccatgaccagggacacctccataaggacagcctacatggagctgagcagcctcagatctgacgacacggccgtgtattactgtgcgaggcgcaagggactaact

SEQ ID NO: 465201 - DNA, 499 bp, Homo sapiens
  misc_feature: HEFZJCU01CQ1UR.10.38.D05.1.454.heavy.3.raw
  modified_base (438)..(438): a, c, t, g, unknown or other
  modified_base (446)..(446): a, c, t, g, unknown or other
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagccacggtcaccgtctccccagcctccaccaagggcccatcggtctccctgcgcctgctcngagcaccnccgagagcacagcggcctggctgcctggtcaagggactactccctactacctt

SEQ ID NO: 465202 - DNA, 497 bp, Homo sapiens
  misc_feature: HEFZJCU01EX21N.12.2.A02.1.454.heavy.3.raw
atacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgagtggatgggatggatcagcgcttacaatggtaacacagactatgcacagaagttccaggacagagtcaccatgaccacagacacatccacgagcacagcctacatggagctgaggagcctgagatctgacgacacggccgtgtattactgtgcgagaggttttagtgatacttattgtagtgggtggtacctgctactttttc

SEQ ID NO: 465203 - DNA, 530 bp, Homo sapiens
  misc_feature: HEFZJCU01BDG4Q.12.40.D07.1.454.heavy.3.raw
atacgacgtacacgaccggtgctcgatttagtgatagagcgtaacaacaggagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccgaggctccaggcaaggggctcgagtgggtggcacttattgcacatgatggcgtcaacaaattctacgcaaattccgtgagggggccgattcaccatctccagagacaattacaagaacaccctttatctgcaatagacagcctgagaccagacgacacggctgtctattattgcgcgagagagacacacgaacctactggccaatactatgggggcttgttctggggccaggggaccctggtcatcgtctccccagcctccaccaagggcccatcggtcttccccctggcgccctcg

SEQ ID NO: 465204 - DNA, 530 bp, Homo sapiens
  misc_feature: HEFZJCU01EOANQ.52.53.E09.1.454.heavy.3.raw
cgcagtacgacacgaccggtgctcgatttagagagagtgtgttgggtttgggggctctgggagaggagcccagcactgggattccgaggtgtttccattcagtgatctgcactgaacacagaggactcgccatggagtttgggctgagctgggttttccttgttgctattttaaaaggtgtccagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttctggggccagggaacccgggtcaccgtctcctcagcctccaccaagggcccatcggtcttccccctggcaccctcctccaagagcacctctc

SEQ ID NO: 465205 - DNA, 510 bp, Homo sapiens
  misc_feature: HEFZJCU01DOF04.4.23.C01.1.454.heavy.3.raw
agcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatgcacagacgttccagggcagagtcaccattaccacagacacatccacgagcacagcctacatggacctgaggagcctgagatttgacgacacggccatatattactgtgcgagagattgggccgacggaaaccttgactactgggccagggaaccctggtcaccgt

SEQ ID NO: 465206 - DNA, 537 bp, Homo sapiens
  misc_feature: HEFZJCU01CJYQX.13.64.F09.1.454.heavy.3.raw
tcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccattaaaaccagcagttatcactgggggtggatccggcagcccccggggaaggagctggagtggatggggaggatttattatactggcaatacttacgacaatccgtccctcaagagtcgagtcaccctgtccgtggacacgccgaataaccagttctccctgaaagtgacctctgtgaccgtcgcagacacggcccatttattattgtgtgagatacgacttttggtaatggctatgactcgatcgactactggggccctggaatcctggtcaccgtctcctcagcctccaccaagggcccatcggtcttccccctggcaccct

SEQ ID NO: 465207 - DNA, 508 bp, Homo sapiens
  misc_feature: HEFZJCU01BEI8Z.51.36.D03.1.454.heavy.3.raw
  modified_base (460)..(460): a, c, t, g, unknown or other
cgatcgtatacacgaccggtgctcgatttagctgcgtcacgatctctcttggggggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactactggggctggatccggcagccccccgggaaggggctggattggattggcagtatcagttatactgggaccaccttcttcaagtcgtcgctcaagagtcgagtcaccatgaccgcggacacgtccaaggaccagttctccctgaagctgacctctgtgaccgccgcagacacggctttgtatttctgtgctagatataatgtggtgacagtggtgcctactacggancttttgattatttggggccaaggcacgaaggtcaccgtctcatctacg

SEQ ID NO: 465208 - DNA, 486 bp, Homo sapiens
  misc_feature: HEFZJCU01B07AG.4.6.A06.1.454.heavy.3.raw
agcactgtagcacgaccggtgctcgatttagatctactgacagggtctcccaggccttgtgaagacctcggagaccctgtccctcacttgcactgtctctggtggctccatcagcagtttctatggggcttggatccggcagcccccagggaagggactggaatggattgggaacacctattacagtgggagccccagctacaatccctccctcaagagtcgactcaccatctcggctgacccgtcaagaatcagttctccctgaggctgacctctgtgaccgccgctgacacggccgtctattactgtgggagacagtgcagtggtggttcgtgccccgagtactggggccgcggaatcttggtcaccgtctcctcagcctccaccaagggcccatcggtcttcccctggcgccctgctccaggagcacctccgagagcacagcggccctgggctgcctggtcaaggacacttccctacagtgct

SEQ ID NO: 465209 - DNA, 540 bp, Homo sapiens
  misc_feature: HEFZJCU01CWBDU.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggctttttcttgtggctttttaaaaggtgcccagtgtgaggtgcaactgttggagtctggggaggcttggtacagccggggggtccctgagactctcctgtgcagcctctggattcaattttaacagctttgccatgggctgggtccgccaggctccagggaaggggctgggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattactgtgcgaaggatcgcccctataatggtggctggatcggggagtttggttctggggccaggggaaccctggtcc

SEQ ID NO: 465210 - DNA, 422 bp, Homo sapiens; identical to SEQ ID NO: 444681
  misc_feature: HEFZJCU01B5AW2.16.78.H01.1.454.heavy.3.raw

SEQ ID NO: 465211 - DNA, 530 bp, Homo sapiens
  misc_feature: HEFZJCU01B5TQ8.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccaggggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggagggcctttcatgtctgggccaagggacgctggtcaccgtctcttcagcctccaccaagggcccatcggtcttcccctggccaccctcctccaagagcacctctggggc

SEQ ID NO: 465212 - DNA, 328 bp, Homo sapiens
  misc_feature: HEFZJCU01ECYN7.19.85.H08.1.454.heavy.3.raw
tactctcgtgcacgaccggtgctcgatttagtatcactcagtcgcggggccggtttaccatctccagagacaatgccaagaagacgctctttctgcaattggacggcctgagagtcgaagacacggctatttattactgtgtgagagaggggggcactggctggtcgggtcgatcttttgatttgtggggccaaggatcaagcgtctccgtctcttcagcctccaccaagggcccatcggtcttccccctggcaccctcctccaagagcacctctgggggcacagcggccctgggctgcctggtcaaggactacttcccacgagagta

SEQ ID NO: 465213 - DNA, 494 bp, Homo sapiens
  misc_feature: HEFZJCU01BE22J.52.20.B09.1.454.heavy.3.raw
cgcagtacgacacgaccggtgctcgatttagtgtagtgtgaagggggctctgggagacgagcccagcactggaagtcgccggtgtttccattcggtgatcatcactgaacacagaggactcaccatggagtttgggctgagctgggttttcctcgttgctcttttaagaggcgtccagtgttatgtgcagctggtggagtctgggggaggcgtggtccagcctgggaggtccctgagactcgcctgtaaaccgtccggatttaccttcagtaactatgcaatgcactgggtccgccaggctccaggcaaggggctggactgggtggcagctatatcatttgatggaagcaataaatactacgcagactccgtgaagggccgattcaccatttccagagacagctccgataacacggtctatctgcgaatgaacagcctgagacctgaggacacggctctttttactgtgcgccaggaagcagtggctggccaca

SEQ ID NO: 465214 - DNA, 535 bp, Homo sapiens
  misc_feature: HEFZJCU01ELV6W.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgaggggagggccagctgctgggagcgtctacatatttcgaccctcgggccgagggaacccgaggtcaccgtctcctcagcctccaccaacgggcccactccgtcttcccctcggcgccctgcctccaggagccacctccgagacgcaccagcggcccgtcgggctgcctggtcgaaggacgtacttcctaccg

SEQ ID NO: 465215 - DNA, 526 bp, Homo sapiens
  misc_feature: HEFZJCU01EYOZ2.53.64.F09.1.454.heavy.3.raw
cgcgtatacacacgaccggtgctcgatttagcgcgtatacaaggggtctgagagaggagcccagccctgggattttcaggtgttttcatgtggtgatcaggactgaacagagagaactcaccatggagtctgggctgacgtggctttttcttgtggctattttaaaaggtgtccagtgcgacgtgcagctggtggagtcggggggaggcttggtacagccgggggggtccctgagactctcctgtagagtctctggcttcacctttagagtctatgacatgagttgggtccgccaggctccggggaaggggctggagtgggtctcaacgatcagtgatagcggaagtaccacaaactacgccgcctccgtgaagggccgatgcaccgtctccagagacaattcgaaggacactttatatctgcaactcaacagactgacaaccgctgacacggccgtctattactgtgtcaaagaagacggaccgctggacgaggagccagaggaaaatcactactttgactacgt

SEQ ID NO: 465216 - DNA, 487 bp, Homo sapiens
  misc_feature: HEFZJCU01AMKEX.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaaggcccatcggtcttcccctgcgccctgctccaggagcacctccgagagcacagcggccctgggctgcctggtcaaggactacttcctacgtgagct

SEQ ID NO: 465217 - DNA, 429 bp, Homo sapiens; identical to SEQ ID NO: 447944
  misc_feature: HEFZJCU01BGPUD.4.37.D04.1.454.heavy.3.raw

SEQ ID NO: 465218 - DNA, 520 bp, Homo sapiens
  misc_feature: HEFZJCU01C4CF4.22.86.H09.1.454.heavy.3.raw
acatacgcgtcacgaccggtgctcgatttagtgctatagacttgggtttgggctgagcgtggtttccgtcgttaggctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagctttgatctctggggccagggacactggtcaccgtctcttcagcctccaccaacgggcccgatccggtctttccccccgttggccgcccgtcgcctcccaggacg

SEQ ID NO: 465219 - DNA, 501 bp, Homo sapiens
  misc_feature: HEFZJCU01ESNFI.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatcgtggggccaagggac

SEQ ID NO: 465220 - DNA, 527 bp, Homo sapiens
  misc_feature: HEFZJCU01B5ZRK.48.61.F06.1.454.heavy.3.raw
agtatacatacacgaccggtgctcgatttagctacgctctaagggaaagggggggagaggagccccagccttggaattcccaagtgttttcattcagtgatcaggactgaacacagaggactcaccatggagtttgggctgagctggattttccttgctgctattttaaaaggtgtccagtgtgaggtgcagctggtgcaggtccgggggggcctggtaccgcctgggggtcccttagactctcctgtgcagcctctggattcatcttcagtaatgtctggatgacctggttccgccaggctccagggaaggggctggagtgggttggccgtgttaaaccaaagctgagggtggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactggactattggggccacgggtaacccg

SEQ ID NO: 465221 - DNA, 529 bp, Homo sapiens
  misc_feature: HEFZJCU01D1FEU.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacggaaaccgtttgactttggggccagggaaccctggtcaccgtctcctcagcctccaccaaggcccatcggtcttcccctggcaccctcctccaagagcacctctgggggcacagcggccctgggctgcctc

SEQ ID NO: 465222 - DNA, 500 bp, Homo sapiens
  misc_feature: HEFZJCU01C7OOS.47.38.D05.1.454.heavy.3.raw
agctcacgtacacgaccggtgctcgatttagtatctgatagttgggtttgggggagagcatcacccagcaaccacatctgtcctctagagaatcccctgagagctccgttcctcaccatggactggacctggaggatcctcttcttggtggcagcagccacaggagtccactcccagttgcaactggtgcagtctggggctgaggtgaagaagcctggggcctcagtgaaggtctcctgcaaggcttctggatacagcttcaccgactactatttgcactgggtgcgacgggcccctggacaagggcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagtttacggacgattacgacgttttgatttggt

SEQ ID NO: 465223 - DNA, 480 bp, Homo sapiens
  misc_feature: HEFZJCU01EXOPF.4.37.D04.1.454.heavy.3.raw
  modified_base (469)..(469): a, c, t, g, unknown or other
agcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagcacagcctacatggacctgagcggcctgacatctgacgacacggcccgtatatttcngtgcgagggag

SEQ ID NO: 465224 - DNA, 525 bp, Homo sapiens; identical to SEQ ID NO: 463467
  misc_feature: HEFZJCU01CDPYU.12.58.F03.1.454.heavy.3.raw

SEQ ID NO: 465225 - DNA, 504 bp, Homo sapiens; identical to SEQ ID NO: 444560
  misc_feature: HEFZJCU01ATSR5.9.33.C11.1.454.heavy.3.raw

SEQ ID NO: 465226 - DNA, 511 bp, Homo sapiens
  misc_feature: HEFZJCU01AKUVT.40.81.H04.1.454.heavy.3.raw
  modified_base (413)..(413): a, c, t, g, unknown or other
  modified_base (459)..(459): a, c, t, g, unknown or other
tctagcgactcacgaccggtgctcgatttagtagtgtagattcgcggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagattttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggntaaaaaactgagcgggacgtggaccgtacgtgacgacacggcgatntatactgtgagagacgttggtggcgtaccgcgggcgtgaccacgtcgggccg

SEQ ID NO: 465227 - DNA, 481 bp, Homo sapiens; identical to SEQ ID NO: 444957
  misc_feature: HEFZJCU01AT5JZ.19.67.G01.1.454.heavy.3.raw

SEQ ID NO: 465228 - DNA, 485 bp, Homo sapiens; identical to SEQ ID NO: 455904
  misc_feature: HEFZJCU01DNQR4.51.76.G10.1.454.heavy.3.raw

SEQ ID NO: 465229 - DNA, 519 bp, Homo sapiens
  misc_feature: HEFZJCU01CN9MC.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaaggcccatcggtcttcccctggcaccctcctccaagagcacctctggggcacagcggcccgtcggctgccgtggtcaaggactacttcctagagacacg

SEQ ID NO: 465230 - DNA, 512 bp, Homo sapiens
  misc_feature: HEFZJCU01EQGVO.4.57.F02.1.454.heavy.3.raw
  modified_base (503)..(503): a, c, t, g, unknown or other
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgcctgctccaggagcacctctggggcncagcggccg

SEQ ID NO: 465231 - DNA, 502 bp, Homo sapiens
  misc_feature: HEFZJCU01COZD4.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaactcctactacggtctggacgtcgt

SEQ ID NO: 465232 - DNA, 507 bp, Homo sapiens
  misc_feature: HEFZJCU01DH9RU.3.17.B06.1.454.heavy.3.raw
  modified_base (484)..(484): a, c, t, g, unknown or other
agacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtntcatagacctaggatacaacgac

SEQ ID NO: 465233 - DNA, 526 bp, Homo sapiens
  misc_feature: HEFZJCU01D0PD3.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccggtctcctcagcctccaccaagggcccatcggtcttcccctggccgccctgctccaggagcacctccgagagcacagcggccctggg

SEQ ID NO: 465234 - DNA, 495 bp, Homo sapiens
  misc_feature: HEFZJCU01AGV8R.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccaagagcacctctgggggcacagcggccctgggctgcctggtaaggactacttccgagtagtaca

SEQ ID NO: 465235 - DNA, 396 bp, Homo sapiens; identical to SEQ ID NO: 445818
  misc_feature: HEFZJCU01BXCGI.16.68.G02.1.454.heavy.3.raw

SEQ ID NO: 465236 - DNA, 485 bp, Homo sapiens
  misc_feature: HEFZJCU01D5881.10.1.A01.1.454.heavy.3.raw
  modified_base (472)..(472): a, c, t, g, unknown or other
catagtagtgcacgaccggtgctcgatttagacgtctcatcaggggctgggagaggagcccagcactagaagtcggcggtgtttccattcggtgatcagcactgaacacagaggactcaccatggagtttgggctgagcgtggtttcgtcgtaggctctttaagaggtgtccagtgtcaagtgcagctggcggagtctgggggaggcgtggtccagcctgggaggtccctgagactctcctgtgcagcctctgggttcaccttcaatacctatggcatgcactgggtccgccaggctccaggcaaggggctggagtgggtggctcttatctcatatgatggaaatgttaaattttatgcagactccgtgaagggccgattcaccatctccagagacaattccaggaacacctgtatctgcaaatgaacagcctgagagctgacgacacggctgtttattactgtgcgacagngcagctgcttaaa

SEQ ID NO: 465237 - DNA, 526 bp, Homo sapiens
  misc_feature: HEFZJCU01BYJXY.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaaggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccactaggtttgactacgtgggggccagggaagcttggtcaccgtctcctcacgcctaccg

SEQ ID NO: 465238 - DNA, 512 bp, Homo sapiens; identical to SEQ ID NO: 445688
  misc_feature: HEFZJCU01D843E.3.34.D01.1.454.heavy.3.raw

SEQ ID NO: 465239 - DNA, 484 bp, Homo sapiens
  misc_feature: HEFZJCU01DQVSE.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctggcgccctgctccaggagcacctccgagacgcacagcggccctgggctgcctggtcaaggactacttcccactactatg

SEQ ID NO: 465240 - DNA, 527 bp, Homo sapiens
  misc_feature: HEFZJCU01CKM9L.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctgggccaagggacgctggtcaccgtctcttcagcctcaccaagggcccatcgtcttccctggcaccctcctccaagagcacctctgggggc

SEQ ID NO: 465241 - DNA, 523 bp, Homo sapiens
  misc_feature: HEFZJCU01CGWNK.12.40.D07.1.454.heavy.3.raw
atacgacgtacacgaccggtgctcgatttagtgatagagcgtaacaacagagggctcaccatggagtttgggctgagctgagttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttccccctggccg

SEQ ID NO: 465242 - DNA, 494 bp, Homo sapiens
  misc_feature: HEFZJCU01BFPOW.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaaggggctggaatgggtctcatctattagtgctaactactggtggcacatacttcgcagactccgtgaagggccggttctccatctccagagacaattccaagaacacgctgtatctgcaattgaacagcctgagagccgaggacacgggccgtatattactgtgcgaaagatttggggaatgaccactc

SEQ ID NO: 465243 - DNA, 507 bp, Homo sapiens
  misc_feature: HEFZJCU01D299S.11.40.D07.1.454.heavy.3.raw
cgagagataccacgaccggtgctcgatttagtgatagagcgtaacaacagaggactcaccatggagtttgggctgacctgggttttcctcgttgctcttttaagaggtgtccagtgtcaggtgcagctggtggagtctgggggaggcgtggtccagcctgggaggtccctgagactctcctgtgcagcctctggattcatcttcaatacctttggcatgcactgggtccgccaggctccaggcaagggactggagtggctatcatttatgtcatttgatggaactaatatatactattctggggccgttaagggtcgattcaccatctccagagacaattccaggaacacgctgtatctgcaattacacagcccgacaactgacgacacggctgtttattactgtgccacagatatacgcgaatttagcaggggtggccagtacagtcatacattttgccaaactggggccagggaaccctggtcatcgtctcctcagcctccaccg

SEQ ID NO: 465244 - DNA, 504 bp, Homo sapiens
  misc_feature: HEFZJCU01C5E9F.13.37.D04.1.454.heavy.3.raw
tcacgtactacacgaccggtgctcgatttagtagcatactgttgggtttgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattgtaatgatggtagctgctactacacttttgactactggggccagggaaccctggtcaccgtctcttcagcctccaccaagggcccatcggtcttcccctggcaccctcctccaagagcacctctgggggcacagcggcctgggctgcctggtcaaggactacttccgtactagacg

SEQ ID NO: 465245 - DNA, 490 bp, Homo sapiens
  misc_feature: HEFZJCU01CKDGO.10.38.D05.1.454.heavy.3.raw
  modified_base (470)..(470): a, c, t, g, unknown or other
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaagggctggagtgggtctcagtttatgaaacagatggcactacatattattctgactccgtgaagggccggttcacctctccagagacacttccaacaacatcttgtatcttcacatgcacaatctgagagtccgacgacacggccacctattattgtgcncgacatgaactcgctcattc

SEQ ID NO: 465246 - DNA, 489 bp, Homo sapiens
  misc_feature: HEFZJCU01AP3PW.11.13.B02.1.454.heavy.3.raw
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaaggcccatcggtcttcccctggcgccctgctccaggagcacctccgagagcacagcggccctgggctgcctggtcaggactacttccgtatctctcg

SEQ ID NO: 465247 - DNA, 528 bp, Homo sapiens
  misc_feature: HEFZJCU01CJEOC.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaacaggtggtccttacaatgaccaccatggaccctgtggacacagccacatatttctgtgcacactctataggagcacctggtagtctgccaaactggttcgacccctgggcccgggaaccctggtcaccgtctcctccagcctccaccaacgggcccatcggtctt

SEQ ID NO: 465248 - DNA, 506 bp, Homo sapiens
  misc_feature: HEFZJCU01CR7K3.10.26.C04.1.454.heavy.3.raw
catagtagtgcacgaccggtgctcgatttagtctagcgactttgggtttggggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggta

SEQ ID NO: 465249 - DNA, 524 bp, Homo sapiens
  misc_feature: HEFZJCU01DHVX7.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgtagagcgtcgtctgtcagtggaattgactactggggccagggaacctggtcaccgtctcctcagcctcc

SEQ ID NO: 465250 - DNA, 532 bp, Homo sapiens
  misc_feature: HEFZJCU01EV0PT.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaaagagttgaggacacggctgttttattactgtacgaaagagggggatacagtggcagctccaagtactactttgacttctggggccagggaaccctggtcaccgtctcctcagcctccaccaacggcccactcggtcttccccctcggcgccctgctccaggagcacctccgagacg

SEQ ID NO: 465251 - DNA, 520 bp, Homo sapiens
  misc_feature: HEFZJCU01CFFZP.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtcctattattgtgttcatagacctaggatacaacgacggtggtacctggtattc

SEQ ID NO: 465252 - DNA, 524 bp, Homo sapiens
  misc_feature: HEFZJCU01C6CHN.16.27.C05.1.454.heavy.3.raw
  modified_base (517)..(517): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggaggccgattcaccgtctccagagacaattccaagaacagggtgtttctccaagtgattgatctgagaagtgaggacacggctgtttattactgtgcgcggtgctgaccgctcttgactacgtggggccggggagccccggtnatcgtct

SEQ ID NO: 465253 - DNA, 470 bp, Homo sapiens
  misc_feature: HEFZJCU01DRZA3.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacactgtatctgcaaatgaacagcctgagagccgacgacacggccatatattactgtgcgaaagcaccggcagttagtcacccatactactttgactactggggccagggaaccctggtcaccgtctcctcagcctccaccaagggcccatcggtcttccccctggcaccctcctccaagagcacctctgggggcacagcggccctgggctgcctggtaaggactacttccgagtagtaca

SEQ ID NO: 465254 - DNA, 506 bp, Homo sapiens
  misc_feature: HEFZJCU01DQ5MV.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccaggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactgggg

SEQ ID NO: 465255 - DNA, 497 bp, Homo sapiens
  misc_feature: HEFZJCU01CV145.48.60.F05.1.454.heavy.3.raw
agtatacatacacgaccggtgctcgatttagtacgtcatcagggaaaggggtctgagagaggagccttagccctggattccaaggcctatccacttggtgatcagcactgagcaccgaggattcaccatggaactggggctccgctgggttatccttgttgctattttagaaggtgtccagtgtgaggtgcagctggtggagtcagggggaggcctggtcaagcctggggggtccctgagactctcctgtgcagcctctggattcaccttcagtacctataccatgaactgggtccgccaggctccagggaaggggctggagtgggtctcatccattagtagtagcagtaattatatagacgacgcagactcagtgaagggccgattcacatctccagagacaacgccaagcactcactgtatctccaaatgaacagcctgagagccgacgacacggctgtgtattactgtgcgagacttgggagagagtgggacct

SEQ ID NO: 465256 - DNA, 484 bp, Homo sapiens; identical to SEQ ID NO: 452752
  misc_feature: HEFZJCU01BI8QO.11.23.C01.1.454.heavy.3.raw

SEQ ID NO: 465257 - DNA, 497 bp, Homo sapiens; identical to SEQ ID NO: 450707
  misc_feature: HEFZJCU01ED923.3.67.G01.1.454.heavy.3.raw

SEQ ID NO: 465258 - DNA, 450 bp, Homo sapiens; identical to SEQ ID NO: 444893
  misc_feature: HEFZJCU01ETLR9.53.57.F02.1.454.heavy.3.raw

SEQ ID NO: 465259 - DNA, 525 bp, Homo sapiens
  misc_feature: HEFZJCU01CLWLT.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtagcccggacagatgatttttggatgtctggggcaaggtacagcggtcaccgtcgcctcagcctccaccaacgggcccatcggtcttcccccgtggccaccctcctcccaagagcacctctgggggcacgac

SEQ ID NO: 465260 - DNA, 511 bp, Homo sapiens
  misc_feature: HEFZJCU01B31ST.9.78.H01.1.454.heavy.3.raw
tgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggccgccctgctccaggacgcacctccgagagcacagccggccctgggctgcctggtcaaggactacttccagacgtatca

SEQ ID NO: 465261 - DNA, 493 bp, Homo sapiens; identical to SEQ ID NO: 455531
  misc_feature: HEFZJCU01BVMZB.47.85.H08.1.454.heavy.3.raw

SEQ ID NO: 465262 - DNA, 524 bp, Homo sapiens; identical to SEQ ID NO: 446401
  misc_feature: HEFZJCU01C3TT2.3.82.H05.1.454.heavy.3.raw

SEQ ID NO: 465263 - DNA, 527 bp, Homo sapiens
  misc_feature: HEFZJCU01DS8OT.16.27.C05.1.454.heavy.3.raw
  modified_base (517)..(517): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacggctgtttattactgtgcgcggtggctgaccgctcttgactactggggccgggagccccggtnactcgtctcc

SEQ ID NO: 465264 - DNA, 544 bp, Homo sapiens
  misc_feature: HEFZJCU01BSHKE.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtcctccccacgcctcccaccaacgggcccatccggtccttcccctcggcgccctgcctccaggacgcaccctccgagacgcaccacgccggcccgtcggggccttcggccgtcgggttcaaacgggaccttaacctttccccaccttaacttac

SEQ ID NO: 465265 - DNA, 409 bp, Homo sapiens; identical to SEQ ID NO: 444519
  misc_feature: HEFZJCU01AN88X.3.41.D08.1.454.heavy.3.raw

SEQ ID NO: 465266 - DNA, 395 bp, Homo sapiens
  misc_feature: HEFZJCU01DDL2Y.16.68.G02.1.454.heavy.3.raw
tgtactactccacgaccggtgctcgatttagtcgatagtgaagggaagggactggagtggattgcctatatctcttacagtgggagcagcaactacaacccctccctcaagagtcgagtcgacatattagtagacacgtccaagaaccagttttccctgaggctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggccctgggctgcctggtcaaggattacttccgagtagtaca

SEQ ID NO: 465267 - DNA, 510 bp, Homo sapiens
  misc_feature: HEFZJCU01AXNZ6.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaacgggcccatcggtccttccccctggcgccctgctccaggagcacctccgagagcacagcggccc

SEQ ID NO: 465268 - DNA, 483 bp, Homo sapiens; identical to SEQ ID NO: 444932
  misc_feature: HEFZJCU01EDAHG.7.10.A10.1.454.heavy.3.raw

SEQ ID NO: 465269 - DNA, 477 bp, Homo sapiens
  misc_feature: HEFZJCU01CPZRG.26.78.H01.1.454.heavy.3.raw
agactatactcacgaccggtgctcgatttagtgtgagtagtttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcctctggattcaccttcagttactatactatgcactgggtccgccaggctccaggcaaggggctggagtgggtggcagttatatcatatgatggaagcagcacatattacacagactccgtgaagggccgattcaccatctccagagacaatttgaagaacacgctgtatctgcaaatgaacagcctgagagctgaagacacggctgtgttttactgtgcgagagaga

SEQ ID NO: 465270 - DNA, 521 bp, Homo sapiens
  misc_feature: HEFZJCU01B9FA9.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagcgtgggttttccttgttagttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacgggccgtctattattgtgtcatagacctaggatacaacgacggtggtacctggtattc

SEQ ID NO: 465271 - DNA, 496 bp, Homo sapiens
  misc_feature: HEFZJCU01ADJCE.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctggggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagagtgggaggtcgatattgta

SEQ ID NO: 465272 - DNA, 396 bp, Homo sapiens; identical to SEQ ID NO: 444469
  misc_feature: HEFZJCU01D2D8E.47.46.E02.1.454.heavy.3.raw

SEQ ID NO: 465273 - DNA, 483 bp, Homo sapiens; identical to SEQ ID NO: 444924
  misc_feature: HEFZJCU01BEE4S.10.35.D02.1.454.heavy.3.raw

SEQ ID NO: 465274 - DNA, 511 bp, Homo sapiens; identical to SEQ ID NO: 446152
  misc_feature: HEFZJCU01AYGJA.3.34.D01.1.454.heavy.3.raw

SEQ ID NO: 465275 - DNA, 504 bp, Homo sapiens
  misc_feature: HEFZJCU01CBFY4.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtctgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggactcgtgggccac

SEQ ID NO: 465276 - DNA, 506 bp, Homo sapiens
  misc_feature: HEFZJCU01EZC2M.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgttgttttggccggtgaactactggggccagggcaccctggtcaccgtctcctcagcttccaccaagggcccatcggtcttcccctggcgccctgctccaggagcacctccgagagcacagcggccctgggctgcctggtcaaggactactcca

SEQ ID NO: 465277 - DNA, 530 bp, Homo sapiens
  misc_feature: HEFZJCU01DAAV7.48.12.B01.1.454.heavy.3.raw
agtatacatacacgaccggtgctcgatttagtagtgtagattccgcgggggctttctgagagtcatggatctcatgtgcaagaaaatgaagcacctgtggttcttcctcctgctggtggcgtctcccagatgggtcctgtcccagctgcacctgcaggagtcgggcccaggactggtgaggccttcggagaccctgtccctcacctgcactgtctctggtgactccatcaacagtggtacttttactactggggctggatccaccagaccccagggaagggtctggagtggattgggagtgtctattctagtgggaacacccactacaatccgtccctcaagagtcgagtcaccatatccgtggacacgtccaagaacgagttctccctgaggttacaatctgtgaccgccgcagacacggctgtatatttactgtgcgagacaccgggagggggcttactatggatcgggcgggagttactactttgactacgtggggccgagggagtcctggtcaccgtctcctcacg

SEQ ID NO: 465278 - DNA, 501 bp, Homo sapiens; identical to SEQ ID NO: 445027
  misc_feature: HEFZJCU01CH5TW.26.23.C01.1.454.heavy.3.raw

SEQ ID NO: 465279 - DNA, 534 bp, Homo sapiens
  misc_feature: HEFZJCU01A2CQW.12.12.B01.1.454.heavy.3.raw
atacgacgtacacgaccggtgctcgatttagtagtgtagattccgcgggggctttctgagagtcatggacctcctgtgcaggaacatgaagcacctgtggtttttcctcctgctggtggcagctcccagatggggcctgtcccaggtgcagctgcaggagtcgggcccaggactggtgaagccttcggagaccctgtccctcacctgcgctgtgtccggtttctccatcagtagtgggcattattggggctggatccggcagcccccagggaaggggctggagtggattgggagtatctattttagcgggagcacctaccagaacgcgtccctcaagagtcgaatcaccatgtcggtggacacatcgaagaaccagatctcccttaagttgaggtctgtgaccgccgctgacacggccgtctattactgtgcgagagtccgtgctggaagaacactttttttgactattggggccaggggaatcctggtcaccgtcgcctcagcctccaccaagggcccatcggtcttcccccg

SEQ ID NO: 465280 - DNA, 426 bp, Homo sapiens
  misc_feature: HEFZJCU01CPWXN.9.34.D01.1.454.heavy.3.raw
tgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgatttcgatccctccgcagtcgacactttgattactggggccggggaaccctggtcgccgtctcctcagcctccaccaagggcccatcggtcttccccctggcaccctcctccaagagcacctctgggggcacagcggccctgggctgcctggtcaaggactacttccagacgtatca

SEQ ID NO: 465281 - DNA, 506 bp, Homo sapiens
  misc_feature: HEFZJCU01EUGRM.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaagggctggagtgggtctcagttattgaaacagatggcactacatattattctgactccgtgaacgggccggttcaccctctccagagacacttccaacaacatcttgtatcttcacatgcacaatctgagagtcgacgacacggccacctattattgtgcgcgacatgactacgctacaattctggggccagggacg

SEQ ID NO: 465282 - DNA, 500 bp, Homo sapiens; identical to SEQ ID NO: 446033
  misc_feature: HEFZJCU01C9QUE.11.27.C05.1.454.heavy.3.raw

SEQ ID NO: 465283 - DNA, 555 bp, Homo sapiens
  misc_feature: HEFZJCU01BHPIP.49.83.H06.1.454.heavy.3.raw
agtcgagagacacgaccggtgctcgatttagatcacgtgcgtcgcggggagctttctgagagtcatggacctcctgtgcaagaacatgaagcacctgtggttcgtcctcctgctggtggcggctcccagatgggtcctgtcccagctgcaactgcaggagtcgggcccaggactggtgaagccttcggagaccctgtccctcacctgcagtgtctctggtgctccatcagcagtagtgattactactggggctggatccgccagcccccagggaagggactggagtggattgggagtgtcttttatactggaaacacctactacaacccgtccctcaagagtcgagtcagcatatcagtagacacgtccaagagccagttctctctgaagctgacgtctctgaacgccgcggacacggccatttattactgtgcgacgtaccccggtaacctttttacgtactttttggagttggtttactattacccggtaagtcgggggtcctttttggtacctttcgttggggccgacggggaacccgtgggtccacccgtt

SEQ ID NO: 465284 - DNA, 520 bp, Homo sapiens; identical to SEQ ID NO: 449320
  misc_feature: HEFZJCU01DGKU3.12.58.F03.1.454.heavy.3.raw

SEQ ID NO: 465285 - DNA, 504 bp, Homo sapiens
  misc_feature: HEFZJCU01DNCFB.47.48.E04.1.454.heavy.3.raw
agctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctggggaggcttggtccagcctggggggtccctcagactctcctgtgcagcctctggattcacctttagttcctcttggatgaattgggtccgccagactccagggaagggctggagtgggttggcaacataaatccagatggaagtcagaaaacctatgtggactctctgaagggccgattcaccatctccagagacaacgccaagaactctctgttctgcaaatggacagcctgagagtcgaagacacggctgtgtattactgtgtgtctctgacgcctcggccggaccttggcttcg

SEQ ID NO: 465286 - DNA, 507 bp, Homo sapiens
  misc_feature: HEFZJCU01C6VJM.48.34.D01.1.454.heavy.3.raw
agtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgcctgctcagagcactccgagagcacagcggccctgggctgcctggtcaaggactactt

SEQ ID NO: 465287 - DNA, 519 bp, Homo sapiens
  misc_feature: HEFZJCU01E0YL8.19.86.H09.1.454.heavy.3.raw
tactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtaggttcgacccctggggccagggaaccctggtcaccgtctcctcagcctccaccaagggcccatcggtcttccccctggcgccctgctccaggagcacctccgacgagcacagcggccc

SEQ ID NO: 465288 - DNA, 503 bp, Homo sapiens
  misc_feature: HEFZJCU01BOYX3.51.86.H09.1.454.heavy.3.raw
cgatcgtatacacgaccggtgctcgatttagtgctatagacttgggtttggggggggagacgagcccagcactggaagtcgccggtgtttccattcggtgatcatcaccgaacacagaggactcaccatggagtttggactgagctgggttttcctcgttgctcttttaagaggtgtccagtgtcaggtgcagctggtggactctgggggaggcgtggtccagcctgggaggtccctgagactctcctgtgcagcctctggattcaccttcaatacttatggcatgcactgggtccgccaggctccaggcaaggggctggagtggctgtcctttatctcatatgatggaggcaacaaaaattatgcagactccgtgaagggccgattcaccatctccagagacaattccaagaacactctatatttgcagatgaatagcctgagaattgaggacgacggctgtgtattactgtgtgagagggtcggcatattccggttttggt

SEQ ID NO: 465289 - DNA, 516 bp, Homo sapiens
  misc_feature: HEFZJCU01A0DZ4.12.71.G05.1.454.heavy.3.raw
  modified_base (464)..(464): a, c, t, g, unknown or other
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaatacgcacagaggttccagggcagagtcaccattaccgcggacgaggccacgaagacagtctacatggaattgagcagcctgagatttgacgacacggcccatgtattactgtgcgaggagggccagctgctgggagcgtctacatatttcgaccctgggccagggaacccaggtcaccgtctcctcagcctccaccaagggcccatcccgtcttccccctggcgccctgctccagngcactccgagagcacagcggccctgggctgcctggtcaaggactacttcctc

SEQ ID NO: 465290 - DNA, 521 bp, Homo sapiens
  misc_feature: HEFZJCU01BEBV8.12.40.D07.1.454.heavy.3.raw
atacgacgtacacgaccggtgctcgatttagtgatagagcgtaacaacagagggctcaccatggagtttgggctgagcgtgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcttcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctcccagcctccaccaagggcccatcggtcttcccctggcg

SEQ ID NO: 465291 - DNA, 524 bp, Homo sapiens
  misc_feature: HEFZJCU01BYDY7.10.44.D11.1.454.heavy.3.raw
catagtagtgcacgaccggtgctcgatttagcgcagtacgaagggggggaggagggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctggggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaagggaggggggaaccaggcgggagttccaagtactcctttgacgtctggggcc

SEQ ID NO: 465292 - DNA, 418 bp, Homo sapiens
  misc_feature: HEFZJCU01D1WBK.40.27.C05.1.454.heavy.3.raw
tctagcgactcacgaccggtgctcgatttagacgcgatcgaagggtttggggctgggtccgccggcccccagggaaggggctggagtgggtttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcaggaagtgggagctggtaggcctcaatactggggccggggaatcctggtcaccgtctcctcagcctccaccaagggcccatcggtcttccccctggcgccctgctccaggagcacctccgagagcacagcggccctgggctgcctggtcaaggactacttccagtcgctaga

SEQ ID NO: 465293 - DNA, 508 bp, Homo sapiens
  misc_feature: HEFZJCU01DYHSE.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgttcatctgaaggaagtgttcaaatctatacagactccgtgaaggggccgattcaccatctccagagacaattccaagaacacgatgtatctgcaaatggacagcctaagagttgaggacacggctgtttattactgtacgaaaggaggggggatacagtggcagctccaagtacgtta

SEQ ID NO: 465294 - DNA, 510 bp, Homo sapiens
  misc_feature: HEFZJCU01AGY4R.10.38.D05.1.454.heavy.3.raw
catagtagtgcacgaccggtgctcgatttagtatctgatagttgggttttccgttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttcccctggcgccctgctccaggagcacctccgagacgcacagcggcccgtgggctgccttc

SEQ ID NO: 465295 - DNA, 396 bp, Homo sapiens; identical to SEQ ID NO: 444469
  misc_feature: HEFZJCU01AZH3M.47.46.E02.1.454.heavy.3.raw

SEQ ID NO: 465296 - DNA, 518 bp, Homo sapiens
  misc_feature: HEFZJCU01B8POB.12.1.A01.1.454.heavy.3.raw
atacgacgtacacgaccggtgctcgatttagacgtctcatcagggggggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagtagtagttattactactggggctggatccgccagcccccaggggacggggctgaagtggattgggagtgtctattatagtgggatcacctactacaacccgtccctcaacgagtcgagtcaccatatccgtcgacacgtccaagaaccagttctccctgaagctgagctctgtgaccgccgcagacacggctgtgtattactgtgcgagacagcccaagacagtattttggagttggttactgttgggactactttgactactggggccaggggaaccctgggt

SEQ ID NO: 465297 - DNA, 533 bp, Homo sapiens
  misc_feature: HEFZJCU01CPL2S.12.12.B01.1.454.heavy.3.raw
atacgacgtacacgaccggtgctcgatttagtagtgtagattccgcgggggctttctgagagtcatggacctcctgtgcaggaacatgaagcacctgtggtttttcctcctgctggtggcagctcccagatggggcctgtcccaggtgcagctgcaggagtcgggcccaggactggtgaagccttcggagaccctgtccctcacctgcgctgtgtccggtttctccatcagtagtgggcattattggggctggatccggcagcccccagggaaggggctggagtggattgggagtatctattttagcgggagcacctaccagaacgcgtccctcaagagtcgaatcaccatgtcggtggacacatcgaagaaccagatctcccttaagttgaggtctgtgaccgccgctgacacggccgtctattactgtgcgagagtccgtgctggaagaacacttttttgactattggggccaggggaatcctggtcaccgtcgcctcagcctccaccaagggcccatcggtcttcccccg

SEQ ID NO: 465298 - DNA, 509 bp, Homo sapiens
  misc_feature: HEFZJCU01EUPY2.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaagggacaatggtcaccggtctcttcagcctccaccaagggcccatcggtcttcccctggcaccctcctccaagagcacctcgtcgggggcac

SEQ ID NO: 465299 - DNA, 519 bp, Homo sapiens; identical to SEQ ID NO: 444867
  misc_feature: HEFZJCU01DO5XS.9.34.D01.1.454.heavy.3.raw

SEQ ID NO: 465300 - DNA, 527 bp, Homo sapiens
  misc_feature: HEFZJCU01DXNLA.17.34.D01.1.454.heavy.3.raw
cgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgcccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctcccttgacttctgggcatggaaccccggtcaccgt

SEQ ID NO: 465301 - DNA, 505 bp, Homo sapiens
  misc_feature: HEFZJCU01BXP6X.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtagagtctgggggaggtgtggtacggcctggggggtccctcagactctcctgtgcaacctctggattcagatttgatgagtatggcatacactgggtccgccaacctccagggaaggggctgcagtgggtctctggtataaactggaatggtgccagcacaacttatgcagactctgtgaagggccgattcaccatctccagagacagtgccgagaactccgtacatctgcaaatgaacagtctcggagtcgaggacacggccttgtatttctgtgcgaggttagcagtggctggtacttacgcaatggacgtcgt

SEQ ID NO: 465302 - DNA, 508 bp, Homo sapiens
  misc_feature: HEFZJCU01DVPWS.52.78.H01.1.454.heavy.3.raw
cgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcac

SEQ ID NO: 465303 - DNA, 490 bp, Homo sapiens
  misc_feature: HEFZJCU01DK7E3.11.38.D05.1.454.heavy.3.raw
cgagagataccacgaccggtgctcgatttagtatctgatagttgggtttgggggaggcttggtacagcctggggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagtggtggtagctgctactggggccagggaaccctggtcaccgtctcctcagcctccaccaagggcccatcggtcttcccctggcaccctcctccaagagcacctctgggggcacagcggccctgggctgcctggtcaaggactactccgtatctctcg

SEQ ID NO: 465304 - DNA, 504 bp, Homo sapiens
  misc_feature: HEFZJCU01D31NG.17.10.A10.1.454.heavy.3.raw
  modified_base (284)..(284): a, c, t, g, unknown or other
  modified_base (444)..(444): a, c, t, g, unknown or other
  modified_base (462)..(462): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttgagtgggtggggtggtcagcggctttgacggtaaggcacagtatgcaccgaagatgaagggcagagtcacgattaccacggacacccccacgaacacagtctacatgacaactgacgagcctgagagctgacgacaccggccgtctattacngtgcgagaattgttttcngtcatcgtacaatttgataggctctatggactggacttcgtc

SEQ ID NO: 465305 - DNA, 519 bp, Homo sapiens; identical to SEQ ID NO: 446650
  misc_feature: HEFZJCU01EAKIW.13.76.G10.1.454.heavy.3.raw

SEQ ID NO: 465306 - DNA, 527 bp, Homo sapiens; identical to SEQ ID NO: 451879
  misc_feature: HEFZJCU01AZO8F.7.78.H01.1.454.heavy.3.raw

SEQ ID NO: 465307 - DNA, 491 bp, Homo sapiens
  misc_feature: HEFZJCU01EU8KO.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttccccctcggcgccctgctccaggagcacctccgagagcacagcggccctgggctgcctggtcaaggactacttcctacgtgagct

SEQ ID NO: 465308 - DNA, 508 bp, Homo sapiens; identical to SEQ ID NO: 445594
  misc_feature: HEFZJCU01BQUCJ.17.25.C03.1.454.heavy.3.raw

SEQ ID NO: 465309 - DNA, 526 bp, Homo sapiens
  misc_feature: HEFZJCU01BXXV8.14.55.E11.1.454.heavy.3.raw
cgtctagtaccacgaccggtgctcgatttagcactcgcacgttgggtttggggggaagaggaagactgacggtccccccaggagttcaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgtattactgtgtcagagatggaggggtggtgatccaggtatgattgtgtactactaccacggtctggacgtctggggccaagggaccacggtcaccgtctcctcagcctccaccaagggcccatcggtcttccccctggcaccctcctccaagagcacctctgggggcacagcggccctgggctgcctggtcaaggactacttccg

SEQ ID NO: 465310 - DNA, 384 bp, Homo sapiens
  misc_feature: HEFZJCU01CB5CU.47.60.F05.1.454.heavy.3.raw
agctcacgtacacgaccggtgctcgatttagtacgtcatcagggaaagggactggagtggattggctatctgtattacggtgggagttcaaacttcaacccctccctcaagagtcgagtcaccatttcaggagacacgtccaagaatcaggtctccttgaacctgaggcagacgaccccagcggacacggccgtctattattgtgcgagaggtcttcttgatgacgatgccctggacgactggggccaggggagtccttgtcaccgtctcctcagcctccaccaagggcccatcggtcttccccctggcaccctcctccaagagcacctctgggggcacagcggccctgggctgcctggtcaaggactacttcctacgtgagct

SEQ ID NO: 465311 - DNA, 519 bp, Homo sapiens
  misc_feature: HEFZJCU01C44WR.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttctccctgaagctgagctctgtgactgccgcggacacggccgtgtattactgtgcgaggtcgattgtgatggtaacaactgcttcttactcctttgaccagtggggccggggaacccgtggtcaccgtctcttcagcctccaccaaggcccatcggtcttcccctggcaccctcctccaagagcacctctgggggcacagcc

SEQ ID NO: 465312 - DNA, 516 bp, Homo sapiens
  misc_feature: HEFZJCU01BXK9Z.52.34.D01.1.454.heavy.3.raw
cgcagtacgacacgaccggtgctcgatttagatcgtctgtgttgggtttggggctgagctgggttttccttgttgctattttagaaggtgtccagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctgggccgtggcaccctggtcactgtcttctcagcctccaccaacgggcccatcggtcttccccctc

SEQ ID NO: 465313 - DNA, 502 bp, Homo sapiens
  misc_feature: HEFZJCU01CW0MU.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgttcatcgtacaatttgataggctctatggactggacttctc

SEQ ID NO: 465314 - DNA, 491 bp, Homo sapiens
  misc_feature: HEFZJCU01AUPF4.12.75.G09.1.454.heavy.3.raw
atacgacgtacacgaccggtgctcgatttagtatagacatcaggggccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattcccaggacagagtcacgattaccgcggacgaatccacgaccacagcctacatagagctgcgcagcctgagatctgaagacacggccatttattactgtgcgagagatgcagggccctcccacatcggttatttctttgactcctggggccagggaaccctggtcaccgtctcct

SEQ ID NO: 465315 - DNA, 512 bp, Homo sapiens
  misc_feature: HEFZJCU01BV9XL.52.86.H09.1.454.heavy.3.raw
cgcagtacgacacgaccggtgctcgatttagtgctatagacttgggtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaaggggacaaatggtcattgtctcttcagccctccaccaagggcccatccggtctttcccccg

SEQ ID NO: 465316 - DNA, 501 bp, Homo sapiens; identical to SEQ ID NO: 447123
  misc_feature: HEFZJCU01E1ICP.3.20.B09.1.454.heavy.3.raw

SEQ ID NO: 465317 - DNA, 499 bp, Homo sapiens; identical to SEQ ID NO: 453123
  misc_feature: HEFZJCU01ENQXQ.47.56.F01.1.454.heavy.3.raw

SEQ ID NO: 465318 - DNA, 503 bp, Homo sapiens; identical to SEQ ID NO: 450415
  misc_feature: HEFZJCU01DLGTE.15.55.E11.1.454.heavy.3.raw

SEQ ID NO: 465319 - DNA, 482 bp, Homo sapiens
  misc_feature: HEFZJCU01EU6KI.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgctttattacattgactactggggccagggaaccctcgtcaccgtctcctcagcctccaccaagggcccatcggtcttcccctggcaccctcctccaagagcacctctgggggcacagcggccctgggctgcctgtcaaggactacttcctagagacacg

SEQ ID NO: 465320 - DNA, 517 bp, Homo sapiens; identical to SEQ ID NO: 446039
  misc_feature: HEFZJCU01AZFX8.9.70.G04.1.454.heavy.3.raw

SEQ ID NO: 465321 - DNA, 518 bp, Homo sapiens; identical to SEQ ID NO: 444718
  misc_feature: HEFZJCU01CBP52.9.34.D01.1.454.heavy.3.raw

SEQ ID NO: 465322 - DNA, 500 bp, Homo sapiens; identical to SEQ ID NO: 450218
  misc_feature: HEFZJCU01DBB0B.17.10.A10.1.454.heavy.3.raw

SEQ ID NO: 465323 - DNA, 512 bp, Homo sapiens
  misc_feature: HEFZJCU01DVZEL.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacaggcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaaccggcagttagtcaccatactactttgaactctggggaccg

SEQ ID NO: 465324 - DNA, 513 bp, Homo sapiens; identical to SEQ ID NO: 446699
  misc_feature: HEFZJCU01C6BYK.12.25.C03.1.454.heavy.3.raw

SEQ ID NO: 465325 - DNA, 511 bp, Homo sapiens
  misc_feature: HEFZJCU01CWXDM.14.25.C03.1.454.heavy.3.raw
  modified_base (321)..(321): a, c, t, g, unknown or other
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtggganagatggaggtcgatattgtagtggtggtagctgctataactggatcgaccctggggccagggaaccctggtcaccgtctcctcagcctccaccaagggcccatcggtcttcccctggcaccctcctccaagagcacctctgggggcacagcggccctgggctgcctggtcaaggactactccgtactacg

SEQ ID NO: 465326 - DNA, 533 bp, Homo sapiens
  misc_feature: HEFZJCU01CQQOJ.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccccgtggggcccggggaaccctggtcaccgtctccccacccctccaaccg

SEQ ID NO: 465327 - DNA, 491 bp, Homo sapiens
  misc_feature: HEFZJCU01AQVO5.53.56.F01.1.454.heavy.3.raw
cgcgtatacacacgaccggtgctcgatttagcagacgtctgaacacacaaagggggagcatcacccagcaaccacatctgtcctccagagaatcccctgagagctccgttcctcaccatggactggacctggaggatcctcttcttggtggcagcagccacaggagcccactcccaggtgaaattgctgcagtctggggctgaggtgaagaagcctggggcctcagtgaaggtctcctgcaagacttctggatacatcttcaccgactactatgttcactgggtgcgacaggcccctggacaaggacttgagtggatgggatggttcaaccctgacactggtgtcgcaacctatgcacagaggtttcagggcagggtcaccatgaccagggacacggtccatcagcacagccctacatggagctacacggcctgagatctgacgacacggccctgttatttttgtgtcgagagagtctattaaagtggctt

SEQ ID NO: 465328 - DNA, 510 bp, Homo sapiens
  misc_feature: HEFZJCU01CQALQ.49.57.F02.1.454.heavy.3.raw
agtcgagagacacgaccggtgctcgatttagctcgatatagttgggtttgggggaggcgtggtccagcctgggaggtccctgagactctcctgtgtagtctctggattcaccttcagggtctatgacatgcactgggtccgccaggctccaggcaaggggctggagtgggtggcagttatatcaaatgatgcaagtaacaaatactatgtagactccgtgaagggccgattcaccatctccagagacaattccaagaatacgctgtatctgcacatgaacagcctgagagccgaagacacgggtgtttattactgtgcgacttaattacggaggacaacggtaacccccgtccgcacggtacggacgtctggggccaagggaccacggtcaccgtctcctcagcctccaccaagggcccatcggtcttcccctggcaccctcctccaagagcacctctgggggcacagcggccctgggctgcctggtcaaggactacttccctctcgact

SEQ ID NO: 465329 - DNA, 511 bp, Homo sapiens; identical to SEQ ID NO: 446224
  misc_feature: HEFZJCU01EJ7H3.7.28.C06.1.454.heavy.3.raw

SEQ ID NO: 465330 - DNA, 395 bp, Homo sapiens; identical to SEQ ID NO: 448398
  misc_feature: HEFZJCU01BWSJK.47.46.E02.1.454.heavy.3.raw

SEQ ID NO: 465331 - DNA, 514 bp, Homo sapiens
  misc_feature: HEFZJCU01CO717.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgttcttcaaatgaacagcctgagagccgatgacacggccgtgtattactgtgcgagagatggggcccacggaacgttactacgctatggacgtctggggaccg

SEQ ID NO: 465332 - DNA, 513 bp, Homo sapiens
  misc_feature: HEFZJCU01BBPVN.21.76.G10.1.454.heavy.3.raw
tcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaacctggggggtccctgagactctcctgtgcggtctctgggttcaccgtcactactaactccatgagctgggtccgccaggctccagggaaggggctggagtgggtctcagttatttatagtggtggtggtgcagattacgcagactccgtgaagggccgattcaccatctccagagacaattccatgaacacgctgtatcttcaaatgaacagcctgagagccgacgacacggccgtctattactgtgcgacgggagtgacgggaggagggcatggatactttgaccactgggggcg

SEQ ID NO: 465333 - DNA, 532 bp, Homo sapiens
  misc_feature: HEFZJCU01E1XGR.48.23.C01.1.454.heavy.3.raw
agtatacatacacgaccggtgctcgatttagtacacgtgattagggattggggatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccaggaaggggctggagtggattgggagtatttaccacagtgggagcacctactacaacccgtccctcaaaagtcgaggcaccatatccgtagacacgtccaagaaccaattactccctgaagctgagctctgtgaccgccgcagacacggctgtctattactgtgcgaggccccgagcgcagtggcgtttttgtattgtcctttcgtatatgtggggccgtaacgggacgaacgtaggtcgaccgtccgtctttcctacggtcctccctacccg

SEQ ID NO: 465334 - DNA, 508 bp, Homo sapiens; identical to SEQ ID NO: 460734
  misc_feature: HEFZJCU01CN1QH.10.88.H11.1.454.heavy.3.raw

SEQ ID NO: 465335 - DNA, 506 bp, Homo sapiens
  misc_feature: HEFZJCU01DXXFN.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccgattcaccatctccagagacgattccaagaacacgttgtatcttcaatgaacagcctgacagtcgacgacacggccatgtatttttgtgcgagcgacccggggctcctcaatggctttcattacg

SEQ ID NO: 465336 - DNA, 513 bp, Homo sapiens; identical to SEQ ID NO: 451379
  misc_feature: HEFZJCU01D64L7.15.23.C01.1.454.heavy.3.raw

SEQ ID NO: 465337 - DNA, 336 bp, Homo sapiens; identical to SEQ ID NO: 444510
  misc_feature: HEFZJCU01BCM5B.3.31.C09.1.454.heavy.3.raw

SEQ ID NO: 465338 - DNA, 536 bp, Homo sapiens
  misc_feature: HEFZJCU01DK3VD.19.10.A10.1.454.heavy.3.raw
tactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccagcccggggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactgggggacggggggaaaattggggccagggaaccctggtctccgtctcgtcag

SEQ ID NO: 465339 - DNA, 462 bp, Homo sapiens
  misc_feature: HEFZJCU01DKN0Y.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagagacagatttaccatgtcaagagatgattcacaaagtacagtgtatctgcaaatgaacagcctgaagaccgaggacacagccatttactattgtacaaatgaatactggggacgggggaaaattggggccagggaaccctggtctccgtctcgtcagcctccaccaagggcccatcggtcttcccctggcgccctgctccaggagcacctccgagagcacagcggccctgggctgcctggtcaaggactacttcccacgagata

SEQ ID NO: 465340 - DNA, 514 bp, Homo sapiens
  misc_feature: HEFZJCU01EDO6I.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagccgcagtggtctttttgatgtccttttgattatggttggggccgaaagggaccaaatgggtcaaccggtctt

SEQ ID NO: 465341 - DNA, 519 bp, Homo sapiens
  misc_feature: HEFZJCU01ESF1U.13.36.D03.1.454.heavy.3.raw
tcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaatggggcgcagggctgttgaagccttcggagaccctgtccctcacgtgcgctgtctctggtgggttcttcagtggttactactggagctggatccgccagtccccagggaaggggctggagtggattggggaaatcaatcatagtggaagcaccaactacaacccgtccctcgagagccgagtcaccatgtcagtagacacgtccaagaaccagttctccctgagggtgagctctgtgaccgccgcggacacggctgtgtacttctgtgcgagaggctaatttttggactcgtcattctccctttgacttcgtggggccaggggaaccctagtcaccgttccg

SEQ ID NO: 465342 - DNA, 519 bp, Homo sapiens
  misc_feature: HEFZJCU01C02BL.52.53.E09.1.454.heavy.3.raw
cgcagtacgacacgaccggtgctcgatttagagagagtgtgttgggtttggggtctgggagaggagcccagcactgggattccgaggtgtttccattcagtgatctgcactgaacacagaggactcgccatggagtttgggctgagctgggttttccttgttgctattttaaaaggtgtccagtgtggagtgcaggtggtggagtctgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcgagcccgtaacttcgtggggccg

SEQ ID NO: 465343 - DNA, 519 bp, Homo sapiens
  misc_feature: HEFZJCU01D6V02.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcctttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctaactggccaatactatgggggcttgttctggggccaggggaccctggtcatcgtctcccagcctccaccaagggccatcggtcttcccctgcg

SEQ ID NO: 465344 - DNA, 534 bp, Homo sapiens
  misc_feature: HEFZJCU01BBTDL.18.59.F04.1.454.heavy.3.raw
tacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatgtgggacaacagactacgctgcacccgtgaaaggcagattcaccatctcaagagatgattcaaaaagcacgctgtatctgcaaatgaacagcctgagaaccgagggacacagccgtgtattactgtaccacatcccctagaagcgtcaactactactactacggtatggacctccg

SEQ ID NO: 465345 - DNA, 528 bp, Homo sapiens
  misc_feature: HEFZJCU01BCHE8.14.35.D02.1.454.heavy.3.raw
cgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggccacagcctacatggagttgagcggcctgagatttgacgacacggccttctattactgtgcgagagaactcgctacgataaatatgcccttgcctcttgactactggggccagggaaccctggtcaccgtctcctcagcctccaccaagggcccatcggtcttccccctggcaccctcctccaagagcacctctgggggcacagcggccctgggctgcctggtcaggactacttccg

SEQ ID NO: 465346 - DNA, 497 bp, Homo sapiens
  misc_feature: HEFZJCU01D9PQQ.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaacgggcccatcggtcttcccctggcgccctgctccagagcacctccgagagcacagcggcccgtgggctgccgtggtccgaaggactaccttcccacgacgagta

SEQ ID NO: 465347 - DNA, 497 bp, Homo sapiens
  misc_feature: HEFZJCU01D3YI6.49.29.C07.1.454.heavy.3.raw
agtcgagagacacgaccggtgctcgatttagagtgctacgaagggaaaggggtgggagaggagcccagcactagaagtcggcggtgcttccattcggtgatcagcactgaacacagaggactcaccatggaatttgggctgagctgggttttcctcgttgctcttttaagaggtgtccagtgtcaggtgcagctggtggagtctggggggaggcggtggtccagcctgggaggtccctgagactctcttgtgctgcctctggattcaccttcagggtctatgacatgcactgggtccgccaggctccaggcaaggggctggagtgggtggcatttatatcatatgatggaagcaagatatactatgtagactccgtgaagggccgattcatcatctccagagacaactccgagaacacgctgtatctgcaaatgaaacaggctggagagctgaagacgacggtctttatattactgtgcgtaacttaatcgaggaac

SEQ ID NO: 465348 - DNA, 517 bp, Homo sapiens
  misc_feature: HEFZJCU01AIBK4.5.41.D08.1.454.heavy.3.raw
atcagacacgcacgaccggtgctcgatttagtcacgcgagaaagggaaagggatgatccgccccagcagctacaggtgtccagtcccaggtgcagctggtgcagtctggggctgccgtgaagaagcctggtcctcggtgacactctcctgcaaggcgtctggagccaccttcaccaactatgctttcaactgggtgcgacgggcccctgggcagggacttgagtggctggggcggatcatccctaccgttgatgtggcaaactatgcacagaagttccagggcagagtcacaattaccgcggacaagtccgcgagcacagcctacatggagctgaacaacctgagatctgaagacacggccgtctattactgtacgacctgcgctacggtgactacgctctgcttcgggacctatatggtctggacgtcgtggggccgaagggagcactgtcaccgtctcctcacgcctccaccaacgggcccatccggtccttcccctcggccaccctccctaccg

SEQ ID NO: 465349 - DNA, 512 bp, Homo sapiens
  misc_feature: HEFZJCU01EPABN.51.68.G02.1.454.heavy.3.raw
cgatcgtatacacgaccggtgctcgatttagtcgatagtgaagggaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagcctggggcctcagtgaaggtctcctgcaagacttctggatacaccttcaccgactactatatgcactgggtgcgacaggcccctggacaagggcttgagtggatgggatggatcgaccctaagaatggtgccacaaactatgcacagacttttcagggctgggtcaccatgaccagcgacacatctagcaacacagtctacatggagttgaccagcctgaccgacacggccgtgtatttttgtgttggagagtagttttcgggactaaatccaagacgtaccccgtgtcggttcggcgaacg

SEQ ID NO: 465350 - DNA, 486 bp, Homo sapiens
  misc_feature: HEFZJCU01CW2VK.51.52.E08.1.454.heavy.3.raw
cgatcgtatacacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagcctggggcctcagtgaaggtctcctgcaagacttctggatacaccttcaccgactactatatgcactgggtgcgacaggcccctggacaagggcttgagtggatgggatggatcgaccctaagaatggtgccacaaactatgcacagacttttcagggctgggtcaccatgaccagcgacacatctagcaacacagtctacatggagttgaccagcctgaccgacacggccgtgtatttttgtgtgagagattttcggacaatccagagaccct

SEQ ID NO: 465351 - DNA, 387 bp, Homo sapiens; identical to SEQ ID NO: 446686
  misc_feature: HEFZJCU01ASNTK.49.34.D01.1.454.heavy.3.raw

SEQ ID NO: 465352 - DNA, 499 bp, Homo sapiens; identical to SEQ ID NO: 454408
  misc_feature: HEFZJCU01C9V39.3.20.B09.1.454.heavy.3.raw

SEQ ID NO: 465353 - DNA, 506 bp, Homo sapiens; identical to SEQ ID NO: 448313
  misc_feature: HEFZJCU01EMS08.52.34.D01.1.454.heavy.3.raw

SEQ ID NO: 465354 - DNA, 532 bp, Homo sapiens
  misc_feature: HEFZJCU01CG1JR.13.26.C04.1.454.heavy.3.raw
tcacgtactacacgaccggtgctcgatttagtctagcgactttgggtttgggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgtcgagaaggacggtttttggggcgcggactcctcttgagatctggggccaggggacaatggtcaccgtctcttctacg

SEQ ID NO: 465355 - DNA, 463 bp, Homo sapiens; identical to SEQ ID NO: 446208
  misc_feature: HEFZJCU01EWHRT.19.10.A10.1.454.heavy.3.raw

SEQ ID NO: 465356 - DNA, 504 bp, Homo sapiens; identical to SEQ ID NO: 448739
  misc_feature: HEFZJCU01E0O7W.52.70.G04.1.454.heavy.3.raw

SEQ ID NO: 465357 - DNA, 510 bp, Homo sapiens; identical to SEQ ID NO: 445542
  misc_feature: HEFZJCU01D1M3L.16.21.B10.1.454.heavy.3.raw

SEQ ID NO: 465358 - DNA, 502 bp, Homo sapiens
  misc_feature: HEFZJCU01BN4AX.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcaggcggcctttgacttc

SEQ ID NO: 465359 - DNA, 521 bp, Homo sapiens; identical to SEQ ID NO: 445317
  misc_feature: HEFZJCU01DL1OP.12.40.D07.1.454.heavy.3.raw

SEQ ID NO: 465360 - DNA, 507 bp, Homo sapiens; identical to SEQ ID NO: 465084
  misc_feature: HEFZJCU01A2WX7.9.78.H01.1.454.heavy.3.raw

SEQ ID NO: 465361 - DNA, 514 bp, Homo sapiens
  misc_feature: HEFZJCU01CBP2H.12.27.C05.1.454.heavy.3.raw
atacgacgtacacgaccggtgctcgatttagacgcgatcgaagggtttggggtctgagagaggagcccagccctgggattttcaggtgttttcatttggtgatcaggactgaacagagagaactcaccatggagtttgggctgagcgtgcgttttctaggtcggctattttaaaaggtgtccagtgtgaggtgcaactggtggagtctgggggaggcttggtacagccgggggggtccctgagactctcctgtgcaggctctggattcatctttaacaactatgccatgagctgggtccgccaggctccagggaaggggctggagtgggtctcagctattagtaatagtggtgatagcacatcctacgcagactccgtgaagggccgcttcaccatctccagagacaattccaagaacacgctgtatctccaaatgaacagtctcagagccgaggacacggccatatattactgtgcgaaagacacagccgcatttgggggagtcatcgtcctt

SEQ ID NO: 465362 - DNA, 527 bp, Homo sapiens
  misc_feature: HEFZJCU01A4O89.40.9.A09.1.454.heavy.3.raw
tctagcgactcacgaccggtgctcgatttagcgagacgcgcagggacagaggactcaccatggaattggggctgagctgggttttccttgttgctattttagaaggtgtccagtgtgcggtgaaactagcggagtctgggggaggcttggtccagcctggggggtccctaagactctcctgcgcagcctctggattcatgtttagtgattattggatggcttgggtccgtcaggctccagggaaagggctggagtttgtggccaagatgaaccacgacggaaatgagaaaaactatgcggactctgtgaagggccgattcaccatttccagagacaacgccaagaagtcactctctctacacatgaccagcctgacagcccgaggacacggctgtttattactgtgcgagagatggcactcggggcggtgactttgactactggggccagggcaccctggtcaccgtctcctcagcctccaccaagggcccatcggtcttccccctggccgccctgcaggagcaccg

SEQ ID NO: 465363 - DNA, 518 bp, Homo sapiens
  misc_feature: HEFZJCU01AGUDZ.49.9.A09.1.454.heavy.3.raw
  modified_base (471)..(471): a, c, t, g, unknown or other
agtcgagagacacgaccggtgctcgatttagcgagacgcgcagggggagccccagccctgggattcccagctgtttctgcttgctgatcaggactgcacacagagaactcaccatggagtttgggctgacctgggttttccttgttgctattttaaaaggtgtccagtgtgaagggcagctggtggagtccgggggaggcttggttcagcctggggggtccctaagactctcctgtgcagcctctggaatcgccttcaataagttttggatgtactgggtccgccaagttccagggaaggggctgatgtgggtctcacgtattgatgttgatgggagttacagtgaccacgcggactctgtgaagggccgattcaccgtctccagagaaaacgccaagaacacggtgtatctgcaaatgactggcctgagagccgaggacacggcagtttattactgtgcaagaggcttgnggtcgactgtcgacctggactggtacttcgatctgtggggcctggca

SEQ ID NO: 465364 - DNA, 400 bp, Homo sapiens; identical to SEQ ID NO: 444452
  misc_feature: HEFZJCU01DF3RT.47.24.C02.1.454.heavy.3.raw

SEQ ID NO: 465365 - DNA, 514 bp, Homo sapiens
  misc_feature: HEFZJCU01EH7FX.19.26.C04.1.454.heavy.3.raw
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctggggccaagggaccacggtcatcgtctccccagcctccaccaagggcccatcggtcttcccctggcgccctgctccaggagcaccc

SEQ ID NO: 465366 - DNA, 516 bp, Homo sapiens
  misc_feature: HEFZJCU01EX9WI.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggatacagtggcagctccaagtactactttgacttctgggccagggaaccctggtcaccgtctcctcagcctccaccaagggcccatcggtcttcccctgcgcctgctcagagcactccg

SEQ ID NO: 465367 - DNA, 527 bp, Homo sapiens
  misc_feature: HEFZJCU01DHTPL.13.38.D05.1.454.heavy.3.raw
tcacgtactacacgaccggtgctcgatttagtatctgatagttgggtttggggagctctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtctgggggggcttggttaagcctggggggtccctcagactctcctgtgcaacctctggattcattttctctgacgcctggttgagctgggtccgccaggctcccgggaaggggctggagtgggttggccgtaattaaaggtagaagacatggtcggacaacagactacagtgttcccgtgaaaggcagattcactatctcaagagatgactcaaaagaaatgatatatctgcaaatgaacaacctgaaaagcgaggacacaggcgtgtattactgtaccacagatgggccagatgcaaatggccgcgacgagttcgacg

SEQ ID NO: 465368 - DNA, 486 bp, Homo sapiens; identical to SEQ ID NO: 445770
  misc_feature: HEFZJCU01AI5NS.3.75.G09.1.454.heavy.3.raw

SEQ ID NO: 465369 - DNA, 520 bp, Homo sapiens
  misc_feature: HEFZJCU01D3B58.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaacgggcccatcggtcttcccctggccaccctcctccaagagcacctctgggggcacagcggccctgggctgcctggtcaaggactacttctagagacacg

SEQ ID NO: 465370 - DNA, 511 bp, Homo sapiens; identical to SEQ ID NO: 448186
  misc_feature: HEFZJCU01DPTS6.21.34.D01.1.454.heavy.3.raw

SEQ ID NO: 465371 - DNA, 502 bp, Homo sapiens
  misc_feature: HEFZJCU01BKTST.48.25.C03.1.454.heavy.3.raw
agtatacatacacgaccggtgctcgatttagtagtgtagatttgggtttggggagctctcagagaggtgccttagccctggattccaaggcatttccacttggtgatcagcactgaacacagaggactcaccatggagctggggctgtgctgggtcttccttgttgcttttttagaaggtgtccagtgtgaggtgcatctggtggagtctggggggagccttggtgcagcctggagagtccctaagactctcctgcgcagcctcaggattcagtttcagtagttatgaaatgaattgggtccgccaggctccagggaagggactggagtggctttcatatattactggcagtgggtctcttacccattatgcagactctgtgagggccgattcaccatctccagagacaaccccgaaactctcttttctgcaatggacagcctgacagccgacgatacggccatttattactgtgcgagagatcgggacccccgcactatcc

SEQ ID NO: 465372 - DNA, 521 bp, Homo sapiens
  misc_feature: HEFZJCU01ECWW2.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttccccctcggcgccctcgctccaggacgcacctctgggggcaccgagccggccc

SEQ ID NO: 465373 - DNA, 483 bp, Homo sapiens; identical to SEQ ID NO: 444924
  misc_feature: HEFZJCU01CT8IQ.10.35.D02.1.454.heavy.3.raw

SEQ ID NO: 465374 - DNA, 397 bp, Homo sapiens; identical to SEQ ID NO: 444534
  misc_feature: HEFZJCU01ELTOL.18.1.A01.1.454.heavy.3.raw

SEQ ID NO: 465375 - DNA, 515 bp, Homo sapiens
  misc_feature: HEFZJCU01CH9K4.17.33.C11.1.454.heavy.3.raw
cgtagactagcacgaccggtgctcgatttagagtgagctcgttgggtttggggactcctgtgccccaccatggacacactttgctccacgctcctgctgctgaccatcccttcatgggtcttgtcccagatcacctttaaggagtctggtcctacgctggtgaaacccacacagaccctcacgctgacctgcaccttctctggcttctcactcagaacgagtggaatgggagtgggctggatccgtcagccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcagctctatggttcggggagttattagtccctactttgactactgggccagggaactctggtcacgtctcgcagcctccaccaagggcccatcgttcc

SEQ ID NO: 465376 - DNA, 507 bp, Homo sapiens
  misc_feature: HEFZJCU01CSOGM.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggccatcggtcttcccctggcaccctcctccaagagcacctctgggggcacagcggccctgggctgcctggtcaggactacttcctacgtcgtat

SEQ ID NO: 465377 - DNA, 504 bp, Homo sapiens
  misc_feature: HEFZJCU01EZKN6.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatcccggtgagcctacggcagcggcctttgacttctc

SEQ ID NO: 465378 - DNA, 521 bp, Homo sapiens
  misc_feature: HEFZJCU01CXEFM.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtctttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctggggccaaggtacagcggtcaccgtcgcctcagcctccaccaagggcccatcggtcttcccctggccaccctcctccaagagcacctctgggggcacacgg

SEQ ID NO: 465379 - DNA, 503 bp, Homo sapiens
  misc_feature: HEFZJCU01C3YMW.49.24.C02.1.454.heavy.3.raw
agtcgagagacacgaccggtgctcgatttagtacagatcgttagggaaagggggggagacgagcccagcactggaagtcgccggtgtttccattcggtgatcatcactgaacacagaggactcaccatggagtttgggctgagctgggttttcctcgttgctcttttaagaggtgtccagtgtcaggtgcttctggtggactctgggggaggcgtggtccggcctgggaggtccctgagactctcctgtgcagcctctcagttcaccttcagtgtctatactatgcactgggtccgccaggctccaggcaaggggctggagtgggtggcacttatatcaaatgatggaagaattcaacactacgcaggctccgtgaagggccgattcaccatctccagagacaattccaagaacacactgtctctgcaaatgaatagcctgagagttgaggacacggctgtctattactgtgcgagagctaagggacttactcatagatttga

SEQ ID NO: 465380 - DNA, 523 bp, Homo sapiens
  misc_feature: HEFZJCU01DF8P0.9.63.F08.1.454.heavy.3.raw
tgatacgtctcacgaccggtgctcgatttagcgatcgtataagggttggtagtccagcccagcccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctggggccaaggtacagcggtcaccgtcgcctcagcctccacctagggcccatcggtcttcccctggcaccctcctccaagagcacctctgggggcacac

SEQ ID NO: 465381 - DNA, 485 bp, Homo sapiens
  misc_feature: HEFZJCU01BDNE2.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttgggatagaagtgcttattacattgactactggggccagggaaccctcgtcaccgtctcctcagcctccaccaagggcccatcggtcttccccctcggcaccctcctccaagagcacctctgggggcacagcggccctgggctgcctggtcaaggactacttcctagagacacg

SEQ ID NO: 465382 - DNA, 523 bp, Homo sapiens
  misc_feature: HEFZJCU01C5CX5.26.57.F02.1.454.heavy.3.raw
  modified_base (382)..(382): a, c, t, g, unknown or other
agactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccggggggtccctgaaactctcatgtgcaggctctggattcacattcagtgactcggctatatactgggtccgccagtctgccgggaaaggctggagtggcttggccgtattagaaccaaacctgacaagtacgcgacaatttatgctgcgtcggtncaaggcaggttcaccatctccagagatgattcagagaacaacggcgtatctgcaaatgaacagcctgaaaaccgaggacgacggccgtcgtattactgtgccagaaccatccgtcgtattacgtatttttcagtggtcccg

SEQ ID NO: 465383 - DNA, 502 bp, Homo sapiens
  misc_feature: HEFZJCU01BQ3NM.53.1.A01.1.454.heavy.3.raw
  modified_base (469)..(469): a, c, t, g, unknown or other
cgcgtatacacacgaccggtgctcgatttagacgtctcatcagggggcatcacataacaaccagattcctcctctaaagaagcccctgggagcacagctcatcaccatggactggacctggaggttcctctttgtggtggcagcagctaccggtgtccagtcccaggtccacctggtgcaatccgggactgaggtgaagaagcctgggtcctcggtgaaggtctcctgcaaggcctctggagacaccttcaacagttatggtatcagttgggtgcgacaggcccctggacaagggcttgagtggatgggaaggatcatcccaatccttggtattacaaaaatgcacagaggtttcagggcagagtcctgttaaccgcggacaaatccactaccacagtctacatggagctgagcagcctgagatctgaagacacggccctgtactattgtgcgagagaaatagtacttntacctgacagtactaatcaatatgcttttgtat

SEQ ID NO: 465384 - DNA, 498 bp, Homo sapiens
  misc_feature: HEFZJCU01ASQ5P.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcacgtctccagagacaattccaggcacacgctgtatctgcaaatgaacagcctgagagctgaggacacggctgtgtattactgtgcgaaagatttctatagaggtggactacgggggcgttcg

SEQ ID NO: 465385 - DNA, 503 bp, Homo sapiens
  misc_feature: HEFZJCU01DJ2YO.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatgggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaacgggcccatcggtcttcccctggccgcctgctcc

SEQ ID NO: 465386 - DNA, 538 bp, Homo sapiens
  misc_feature: HEFZJCU01BSHY3.48.37.D04.1.454.heavy.3.raw
agtatacatacacgaccggtgctcgatttagtagcatactgttgggtttggggacttttccaatttttttgggggccagcgctgggtctcttgccaagagaaccccggagtagttgggggggctcaggaacctgccctaagacaacagcgtccacacagacgaggggctacgggtcctcacagacgaagggcacggggtccagatgatccctcctcctggccccgccacctcgtctctttctgcggccaggcgcactctgggcctctggggtcaagtggccggcaaccccgggccctccccggcctctgtctcagagagtcccagggacgtggcggggcgccggttcttccctggggtcctggcgttgttgtcaccttgtgtcacctgtttcgacccctgggcccagggagccctggtcaccgtctccttagcctccaccaagggcccatcggtcttcccctggcgcctgctccaggagcacctccgagagcacagcggcctgggctgcctggtcaaggactacttcctatgtatact

SEQ ID NO: 465387 - DNA, 525 bp, Homo sapiens
  misc_feature: HEFZJCU01ETJAL.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatggggcttgttctggggccaggggaccctggtcatcgtctccccagcctccaccaagggcccatcggtcttcccctggcgcctcg

SEQ ID NO: 465388 - DNA, 500 bp, Homo sapiens; identical to SEQ ID NO: 445807
  misc_feature: HEFZJCU01BSJ6T.40.81.H04.1.454.heavy.3.raw

SEQ ID NO: 465389 - DNA, 493 bp, Homo sapiens
  misc_feature: HEFZJCU01DNWVQ.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctatactactgtgcgagagagttgacgagtct

SEQ ID NO: 465390 - DNA, 524 bp, Homo sapiens
  misc_feature: HEFZJCU01DWP46.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactactggggttcgacccctggggccagggaaccctggtcaccgtctcctcagcctccacc

SEQ ID NO: 465391 - DNA, 534 bp, Homo sapiens
  misc_feature: HEFZJCU01BH8GC.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgtagagcgtcgtctgtcagtggaattgactatggggccagggaaccctggtcaccgtcctcctcagccctccaccaacggg

SEQ ID NO: 465392 - DNA, 541 bp, Homo sapiens
  misc_feature: HEFZJCU01DMU1V.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagcgtgcgtttctaggtggcttttaaaggtgccagtgtgaggtgcaactgttggagtctgggggaggcttggtacagccgggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcattaaccagcctgagagtcgaggacacggccctttattactgtgcgaaggatcgccctataatggtggctggatcgggggtagtttgggttcctggggccgagggaaccctgggtcc

SEQ ID NO: 465393 - DNA, 493 bp, Homo sapiens
  misc_feature: HEFZJCU01DMDBZ.52.53.E09.1.454.heavy.3.raw
cgcagtacgacacgaccggtgctcgatttagagagagtgtgttgggtttgggggaggcttggtccagcctggtggttccctgagactctcctgtgcagcctctggatttccgtcagtagcaactacatgagctgggtccgccgggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttctggggccagggaacccgggtcaccgtctcctcagcctccaccaagggcccatcggtcttccccctggcaccctcctccaagagcacctctgggggcacagcggccctgggctgcctggtcaaggactactcctatacgatcg

SEQ ID NO: 465394 - DNA, 521 bp, Homo sapiens
  misc_feature: HEFZJCU01C16FK.47.46.E02.1.454.heavy.3.raw
agctcacgtacacgaccggtgctcgatttagactcatctacagggaaagggggagagaggagcccagccctgggattttcaggtgttttcatttggtgatcaggactgaaccgagagaactcaccatggagtttgggctgagctggctctttcttgtggcttttttaaaaggtgtccagtgtgaggtgcaactgttggagtctgggggagacttagtacaccctggggggtccctgagactctcctgtgcagcctctggactcacctttagcaactctgtcatgggctgggtccgccaggctccggggaagggctggagtgggtctcaagtattgatgagaatggtggaagcacattctacgtggactccgtgaagggccgttcaccatctccagagacaatttcaggagcacgctgtatctacaaatgaacagcctgagagccgaggacacggccgtatatttctgtgcgaaagtctatagcagtgccccctacgcgcacttctttgacttctggggcca

SEQ ID NO: 465395 - DNA, 392 bp, Homo sapiens; identical to SEQ ID NO: 444682
  misc_feature: HEFZJCU01BHUPH.16.70.G04.1.454.heavy.3.raw

SEQ ID NO: 465396 - DNA, 314 bp, Homo sapiens
  misc_feature: HEFZJCU01DF3X9.13.17.B06.1.454.heavy.3.raw
tcacgtactacacgaccggtgctcgatttagtcgatagtgaagggccgattcaccatctccagagacaacgccaagaactcactgtatctgcagatgaccagcctgagagtcgaggatacggctgtgtattattgtgcgagagatggggcacgacattttgtagaggtgtactggggccagggagccccggtcaccgtctcctcagcctccaccaagggcccatcggtcttccccctggcgccctgctccaggagcacctccgagagcacagcggccctgggctgcctggtcaaggactacttccagtacgtga

SEQ ID NO: 465397 - DNA, 526 bp, Homo sapiens; identical to SEQ ID NO: 446878
  misc_feature: HEFZJCU01DWCGD.18.33.C11.1.454.heavy.3.raw

SEQ ID NO: 465398 - DNA, 528 bp, Homo sapiens
  misc_feature: HEFZJCU01EAQ8X.48.4.A04.1.454.heavy.3.raw
agtatacatacacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttctccctgaaactgaccgctgtgaccgccgcggacacggctgtgtattactgtgcgagacgaatgggcgggtggctacgacttgacttttgggccgagggaaacctggtcaccgtcctccccagccttccaccaaggcccatcggtctttcccccg

SEQ ID NO: 465399 - DNA, 531 bp, Homo sapiens
  misc_feature: HEFZJCU01E2HAH.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccgactaatattaactgttgcgaaagacgaccggaccagttagtacacccaactaccttacctttagtaactacctaggggtccc

SEQ ID NO: 465400 - DNA, 513 bp, Homo sapiens
  misc_feature: HEFZJCU01DL8K7.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatataattactgtgcgaaagcaccggcagttagtcacccatactactttgactactggggccaac

SEQ ID NO: 465401 - DNA, 511 bp, Homo sapiens
  misc_feature: HEFZJCU01EC809.48.27.C05.1.454.heavy.3.raw
agtatacatacacgaccggtgctcgatttagacgcgatcgaagggtttggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacactccacgagcacagcctacatggagctgaggagcctgagatctgacgacacggccgtgtattactgtgcgagagtaaggtttactatggttcggggagtcgtccgaccagcaactggtcgtacccc

SEQ ID NO: 465402 - DNA, 509 bp, Homo sapiens
  misc_feature: HEFZJCU01EE0WJ.4.67.G01.1.454.heavy.3.raw
  modified_base (483)..(483): a, c, t, g, unknown or other
agcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggcgttttcttaggtggctattttaaaaggtgtccagtgtgaagtgcagctggtggagtctgggggaggcctggcacagccgggggggtccctgagactctcctgtgcagcctctggattcagttttagaatgtctgccatgacctggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgcaaagntctcgggctggttccgcggtccgggt

SEQ ID NO: 465403 - DNA, 515 bp, Homo sapiens
  misc_feature: HEFZJCU01DYLEL.10.87.H10.1.454.heavy.3.raw
catagtagtgcacgaccggtgctcgatttagcagtactgcgttgggtttggggagctctgggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtctgggggaggcgtggtccagcctggggggtccctgagactctcctgtgcagcctctggattcgacttcgaaatgtctggcatgcactgggtccgccaggctccaacgaaggggctggagtgggtggcagttctttcatttgatgaaaaagggatattatgcgacctccgtgaagggccgattcagcatctccagagacatttccaaggccacggtgtatctgcaaatgaccagcctgagaagtgaggacacggctatgtactattgtgcgaaggaccttccacctagaaactaatagtggggggtcg

SEQ ID NO: 465404 - DNA, 491 bp, Homo sapiens; identical to SEQ ID NO: 445333
  misc_feature: HEFZJCU01A2IX3.19.53.E09.1.454.heavy.3.raw

SEQ ID NO: 465405 - DNA, 538 bp, Homo sapiens
  misc_feature: HEFZJCU01DVAIF.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatcccctgaaagcgtcaactactactactacggtatggacctctggggaccg

SEQ ID NO: 465406 - DNA, 523 bp, Homo sapiens
  misc_feature: HEFZJCU01EI5JQ.13.33.C11.1.454.heavy.3.raw
tcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacggcaaatatggtttcaggggagttcgactactggggccagggaaccctggtcaccgtctcctcagcctccaccaaggg

SEQ ID NO: 465407 - DNA, 450 bp, Homo sapiens; identical to SEQ ID NO: 444893
  misc_feature: HEFZJCU01BR8YM.53.57.F02.1.454.heavy.3.raw

SEQ ID NO: 465408 - DNA, 497 bp, Homo sapiens
  misc_feature: HEFZJCU01ELQCE.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgagggccgattcaccatctccagagacgattccaagaacacgttgtatcttcaatgaacagcctgacagtcgacgacacggccatgtatttttgtgcgagcgaccggggctcctcatggctttc

SEQ ID NO: 465409 - DNA, 528 bp, Homo sapiens
  misc_feature: HEFZJCU01DANCL.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtcgtggggggggcgtggtccagcctgggaggtccctgagactctcctgtgcaggcttctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaagagggggatacagtggcagctccaagtactactttgacttctgggccagggaaccctggtcaccgtctcctcacgcctccaccaagggcccatcggtcttcccctggcgccctgctccaggagcacctccgagacg

SEQ ID NO: 465410 - DNA, 508 bp, Homo sapiens; identical to SEQ ID NO: 446002
  misc_feature: HEFZJCU01BUYZH.9.78.H01.1.454.heavy.3.raw

SEQ ID NO: 465411 - DNA, 513 bp, Homo sapiens
  misc_feature: HEFZJCU01DS5P1.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggcgattcaccatctccagagacaactccaggaacacaatgtatttggacctgaacagcctaagtcctgaggacacgggtgtatactactgtacgaaggagggggaaccgagcgggagtccaagtactctttg

SEQ ID NO: 465412 - DNA, 502 bp, Homo sapiens; identical to SEQ ID NO: 459940
  misc_feature: HEFZJCU01E17VZ.3.67.G01.1.454.heavy.3.raw

SEQ ID NO: 465413 - DNA, 476 bp, Homo sapiens
  misc_feature: HEFZJCU01EJQ2R.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccgggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 465414 - DNA, 517 bp, Homo sapiens
  misc_feature: HEFZJCU01CO8RW.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaaggacacctccacaaaccaggtggtccttacaatgaccaatatggaccctgtggacacagccacatattactgttcacgctctatggttcggggagttattagtccctactttgactactggggccagggaactctgtcaccgtctccgcagcctccaccaagggcccatcc

SEQ ID NO: 465415 - DNA, 427 bp, Homo sapiens; identical to SEQ ID NO: 444708
  misc_feature: HEFZJCU01BK7GX.9.34.D01.1.454.heavy.3.raw

SEQ ID NO: 465416 - DNA, 394 bp, Homo sapiens
  misc_feature: HEFZJCU01AXR7I.16.24.C02.1.454.heavy.3.raw
tgtactactccacgaccggtgctcgatttagtacagatcgttagggaaaggggctggagtgggtctcaagtattagtggtgttggtggtctcacatattacgcagactccgtgaagggccggttcaccgtctccagagacaattccaagaacacactgtatctgcaaatgaacagcctgagagccgacgacacggccatatattactgtgcgaaagcaccggcagttagtcacccatactactttgactactggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 465417 - DNA, 510 bp, Homo sapiens
  misc_feature: HEFZJCU01CCEQ7.7.28.C06.1.454.heavy.3.raw
  modified_base (337)..(337): a, c, t, g, unknown or other
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggngacctactatttggactctgtgaggggccgattcatcatctccagagacaacgccgacaactcactgtctctgctgatgagcagcctgagagccgacgacacggctatctattactgtgcgaaactctcattccgttcatctgaatactggggccagggaacctggtcgtccg

SEQ ID NO: 465418 - DNA, 392 bp, Homo sapiens; identical to SEQ ID NO: 444682
  misc_feature: HEFZJCU01EFLAJ.16.70.G04.1.454.heavy.3.raw

SEQ ID NO: 465419 - DNA, 510 bp, Homo sapiens
  misc_feature: HEFZJCU01EFY5I.52.86.H09.1.454.heavy.3.raw
cgcagtacgacacgaccggtgctcgatttagtgctatagacttgggtttggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctgggccaagggacaatggtcattgtctcttcagcctccaccaagggcccatcggtcttcccctggccaccctcctccaagagcacctcgtgggggcacacgcggccctgggctcgcctggtcaaggactactcctac

SEQ ID NO: 465420 - DNA, 378 bp, Homo sapiens; identical to SEQ ID NO: 444419
  misc_feature: HEFZJCU01CK7YY.47.77.G11.1.454.heavy.3.raw

SEQ ID NO: 465421 - DNA, 489 bp, Homo sapiens
  misc_feature: HEFZJCU01CQJX6.53.56.F01.1.454.heavy.3.raw
cgcgtatacacacgaccggtgctcgatttagcagacgtctgaacacacaaagggggagcatcacccagcaaccacatctgtcctccagagaatcccctgagagctccgttcctcaccatggactggacctggaggatcctcttcttggtggcagcagccacaggagcccactcccaggtgaaattgctgcagtctggggctgaggtgaagaagcctggggcctcagtgaaggtctcctgcaagacttctggatacatcttcaccgactactatgttcactgggtgcgacaggcccctggacaaggacttgagtggatgggatggttcaaccctgacactggtgtcgcaacctatgcacagaggtttcagggcgagggtcaccatgaccagggacacgtccatcagcacagcctacatggagctacacggcctgagatctgacgacacggccctgtatttttgtgtcgagagagtctattaaagtggctt

SEQ ID NO: 465422 - DNA, 508 bp, Homo sapiens
  misc_feature: HEFZJCU01BFM5W.26.37.D04.1.454.heavy.3.raw
agactatactcacgaccggtgctcgatttagtagcatactgttgggtttggggagctctgggagaggagcccagcactggaagtcgccggtgtttccattcggtgatcagcactgaacacagaggactcaccatggagtttgggctgaactgggttttcctcgttgctcttttaagaggtgtccagtgtcaggagcaggtagtggagtctgggggaggcgtggtccagcctggggggtccctgagactctcctgtgcagcctctggattcaccttcagtacctacgccatgcactggatccgccaggctccaggcaaggggctagagtgggtggctcttatatcatatgatggaagtaatgaacattacgcagactccgtgaagggccgattcaccgtctccagagacaattccaagagcacgatgtttctgcaaatgaacagcctgagagttgaggacacgggtgtctatttctgttgcgcgagtccgggtgaggggtgtccactac

SEQ ID NO: 465423 - DNA, 507 bp, Homo sapiens
  misc_feature: HEFZJCU01DV35B.51.86.H09.1.454.heavy.3.raw
cgatcgtatacacgaccggtgctcgatttagtgctatagacttgggttttcctcgttgctcttttaagaggtgtccagtgtcaggtgcagctggtggactctgggggaggcgtggtccagcctgggaggtccctgagactctcctgtgcagcctctggattcaccttcaatacttatggcatgcactgggtccgccaggctccaggcaaggggctggagtggctgtcctttatctcatatgatggaggcaataaaattatgcagactccgtgaagggccgattcaccatctccagagacaattccaagaacactctatatttgcagatgaatagcctgagaattgaggacacggctgtgtattactgtgtgagagggtcggcatattccggtttttggagtaattatctactgggaactttgtatatctggggccacgggacaatggtcaccgtctcttcagcttccaccaacgggccatcggtcttcccctcggcgccctgctcca

SEQ ID NO: 465424 - DNA, 518 bp, Homo sapiens; identical to SEQ ID NO: 461172
  misc_feature: HEFZJCU01BUDCF.9.34.D01.1.454.heavy.3.raw

SEQ ID NO: 465425 - DNA, 382 bp, Homo sapiens
  misc_feature: HEFZJCU01DS243.47.60.F05.1.454.heavy.3.raw
agctcacgtacacgaccggtgctcgatttagtacgtcatcagggaaagggactggagtggattggctatctgtattacggtgggagttcaaacttcaacccctccctcaagagtcgagtcaccatttcaggagacacgtccaagaatcaggtctccttgaacctgaggcagacgaccccagcggacacggccgtctattattgtgcgagaggtcttcttgatgacgatgccctggacgactggggccagggagtccttgtcaccgtctcctcagcctccaccaagggcccatcggtcttccccctggcaccctcctccaagagcacctctgggggcacagcggccctggctgcctggtcaaggactacttcctacgtgagct

SEQ ID NO: 465426 - DNA, 508 bp, Homo sapiens; identical to SEQ ID NO: 445594
  misc_feature: HEFZJCU01ACXLL.17.25.C03.1.454.heavy.3.raw

SEQ ID NO: 465427 - DNA, 483 bp, Homo sapiens; identical to SEQ ID NO: 444639
  misc_feature: HEFZJCU01D5LEV.11.23.C01.1.454.heavy.3.raw

SEQ ID NO: 465428 - DNA, 436 bp, Homo sapiens
  misc_feature: HEFZJCU01AM8NU.3.21.B10.1.454.heavy.3.raw
agacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgtttattactgtgcaagagcgaggaggagcagttttgacagctggggccagggaaccctggtcaccgtctcctcagcctccaccaagggcccatcggtcttccccctggcgccctgctccaggagcacctccgagagcacagcggccctgggctgcctggtcaaggactacttccgatgcgtct

SEQ ID NO: 465429 - DNA, 379 bp, Homo sapiens; identical to SEQ ID NO: 444450
  misc_feature: HEFZJCU01DL5H2.47.77.G11.1.454.heavy.3.raw

SEQ ID NO: 465430 - DNA, 507 bp, Homo sapiens; identical to SEQ ID NO: 457903
  misc_feature: HEFZJCU01D2XA9.8.38.D05.1.454.heavy.3.raw

SEQ ID NO: 465431 - DNA, 506 bp, Homo sapiens; identical to SEQ ID NO: 444696
  misc_feature: HEFZJCU01DL4XF.16.34.D01.1.454.heavy.3.raw

SEQ ID NO: 465432 - DNA, 531 bp, Homo sapiens
  misc_feature: HEFZJCU01CYJPA.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtgaattgactactggggccagggaaccctggtcaccgtctcctcagcctccaccaaggg

SEQ ID NO: 465433 - DNA, 549 bp, Homo sapiens
  misc_feature: HEFZJCU01C7J90.15.86.H09.1.454.heavy.3.raw
tctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaaagtaaaatgatggtgagaaaatagactacggtgcacccgtgaaaggaagattcacatctcaagagataattcaaaaacgacggtgtatttgcaatgaacagcctgaaaaccgaggacacagccgtctattactagtaccacagattcggaagtgcatcgacgtaaaggaggactatgcttttgattatctggggcccaggggacaagtc

SEQ ID NO: 465434 - DNA, 325 bp, Homo sapiens
  misc_feature: HEFZJCU01BCCB5.49.73.G07.1.454.heavy.3.raw
agtcgagagacacgaccggtgctcgatttagctctacgctcagggccatctccagagacaattccaagaacacgctgtatctgcaaatgaacagcctgagacctgaggacacggctgtttatttctgtgcgaacttaatcacggaggacaacggtgacccccgtccgctcggtgcggaggtctggggccaagggaccacggttattgtctcctcagcctccaccaagggcccatcggtcttccccctggcaccctcctccaagagcacctctgggggcacagcggccctgggctgcctggtcaaggactacttcctctctcgact

SEQ ID NO: 465435 - DNA, 534 bp, Homo sapiens
  misc_feature: HEFZJCU01BYNK1.12.12.B01.1.454.heavy.3.raw
atacgacgtacacgaccggtgctcgatttagtagtgtagattccgcgggggctttctgagagtcatggacctcctgtgcaggaacatgaagcacctgtggtttttcctcctgctggtggcagctcccagatggggcctgtcccaggtgcagctgcaggagtcgggcccaggactggtgaagccttcggagaccctgtccctcacctgcgctgtgtccggtttctccatcagtagtgggcattattggggctggatccggcagcccccagggaaggggctggagtggattgggagtatctattttagcgggagcacctaccagaacgcgtcctcaagagtcgaatcaccatgtcggtggacacatcgaagaaccagatctcccttaagttgaggtctgtgaccgccgctgacacggccgtctattactgtgcgagagtccgtgctggaagaacactttttttgactattggggccaggggaatcctggtcaccgtcgcctcagcctccaccaagggccccatcggtcttcccccg

SEQ ID NO: 465436 - DNA, 506 bp, Homo sapiens
  misc_feature: HEFZJCU01BJWIN.48.31.C09.1.454.heavy.3.raw
agtatacatacacgaccggtgctcgatttagacgtctcatcaaggaaggaagggggagagaggagccttagccctggattccaaggcctatccacttggtgatcagcactgagcaccgaggattcaccatggaactggggctccgctgggttttccttgttgctattttagaaggtgtccagtgtgaagtacagctggtggagtctgggggaggcctggtcaagcctggggggtccctgagactctcctgtgcaacctctggattcacattcactagatataccatgaactgggtccgccaggctccagcgaaggggctggagtgggtctcctccataagtagtggcagttcttacttacattacgcagactcagtgaagggccgattcgccatctccagagacaacgccaacaactcactgtttctgcagatggacaacctgagaggcgaggacacggctgtatattactgtgtctcccatacatcgcagctcgtggcacggtac

SEQ ID NO: 465437 - DNA, 512 bp, Homo sapiens
  misc_feature: HEFZJCU01DF2CA.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatggggaaggatcgtccctatcgttgacacaccaaactagcacagaagttccagggcagactcaccataaccgcggacaattaacgaacacagttaatctggagctgaacagcctgtcatctgaggacacgggcttctacttctgtgcgaggagtaattactataacactgctcttttacacctcccttgacttctggggcca

SEQ ID NO: 465438 - DNA, 500 bp, Homo sapiens
  misc_feature: HEFZJCU01DWRTE.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaaccaggtggtccttacaatgaccaacatggaccctgtggacacaagccacatattactgtgcacagagatacgggcagccacggtggtttggggctacgtggggccagggaaccctggtcaccgtctcctcagcctccaccg

SEQ ID NO: 465439 - DNA, 521 bp, Homo sapiens; identical to SEQ ID NO: 457176
  misc_feature: HEFZJCU01B4A1S.12.40.D07.1.454.heavy.3.raw

SEQ ID NO: 465440 - DNA, 484 bp, Homo sapiens
  misc_feature: HEFZJCU01DR7T2.19.53.E09.1.454.heavy.3.raw
tactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatagaacagtctgagagctgaggacacggccttgtattactgtgcaaggaggtatagc

SEQ ID NO: 465441 - DNA, 505 bp, Homo sapiens
  misc_feature: HEFZJCU01EOGDB.49.73.G07.1.454.heavy.3.raw
agtcgagagacacgaccggtgctcgatttagctctacgctcagggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtgacttttatttcatatgatggaagtaataaatactatgcagactccgtgaagggccgattcaccatctccagagacaattccaagaacacgctgtatctgcaaatgaacagcctgagacctgaggacacggctgtttatttctgtgcgaacttaatcacggagacaacggtcgacccccgtccg

SEQ ID NO: 465442 - DNA, 507 bp, Homo sapiens
  misc_feature: HEFZJCU01AH4RT.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgttgcgcgacatgactacgctcaattctggggccagggacg

SEQ ID NO: 465443 - DNA, 390 bp, Homo sapiens; identical to SEQ ID NO: 444541
  misc_feature: HEFZJCU01C97UW.16.24.C02.1.454.heavy.3.raw

SEQ ID NO: 465444 - DNA, 528 bp, Homo sapiens
  misc_feature: HEFZJCU01CK1OO.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtcccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacggctgtttattactgtgcgcggtggctgaccgctcttgactactggggccgggggagccccgggtcatcgtct

SEQ ID NO: 465445 - DNA, 524 bp, Homo sapiens
  misc_feature: HEFZJCU01EP85Z.53.76.G10.1.454.heavy.3.raw
cgcgtatacacacgaccggtgctcgatttagtcactcatacagggggagtctccctcactgcccagctgggatctcagggcttcattttctgtcctccaccatcatggggtcaaccgccatcctcgccctcctcctggctgttctccaaggagtctgtgccgaggtgcagctggtgcagtctggaacagaggtgaaaaagccgggggagtctctgaagatctcctgtaagggttctggatacaactttaccacctactggatcgcctgggtgcgccagatgcccggaaaaggcctggagtggatgggcatcgtcaatcctagtgactctgaagccacatacagcccgtccttccaaggccaggtcaccctctcagccgacaagtccatcagcgccgccttcctgcagtggcgcggcctggaggcctcggacaccgccacatattacctgtgcgagacttactagtttggggggagtttatcgttgtttccctcctacgtgggtggtctttttcggattgtcgtc

SEQ ID NO: 465446 - DNA, 481 bp, Homo sapiens
  misc_feature: HEFZJCU01DR617.12.85.H08.1.454.heavy.3.raw
atacgacgtacacgaccggtgctcgatttagtatcactcagtcgcggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattactgtgcgaaggatcgcccctataatggtggctggatcggggagtttggttcctggggccagggaaccctggtcaccgtctcctcagcctccaccaagggcccatcggtcttcccctggcaccctcctccaagagcacctctgggggcacagcggccctgggctgcctggtcaaggactacttcctacgtcgtat

SEQ ID NO: 465447 - DNA, 515 bp, Homo sapiens
  misc_feature: HEFZJCU01AWYD9.47.55.E11.1.454.heavy.3.raw
agctcacgtacacgaccggtgctcgatttagcactcgcacgttgggtttgggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgttgttttcgatgccttcggtccgcgggacttcgtggggccagggtaacccg

SEQ ID NO: 465448 - DNA, 497 bp, Homo sapiens
  misc_feature: HEFZJCU01CDY86.48.77.G11.1.454.heavy.3.raw
agtatacatacacgaccggtgctcgatttagctagtcactcaagggaaaggggtctgggagacgagcccagcactggaagtcgccggtgtttccattcggtgatcagcactgaacacagaggactcaccatggagtttgggctgacctgggttttcctcgttgctcttttaagaggtgtccagtgtcaggtgcagctggtggagtctgggggaggcgtggtccagcctgggaggtccctgagactctcttgtgcagcctctggattcattttcagtgactatggtatgcactgggtccgccaggctccaggcaaggggctggagtgggtggcagtcataccttctgctggaaggaatatctactacgcgggctccgtgaagggcgattcaccatctccagagacaattccaacaagacaactgtatctgcaaatgaacagcctgagggctgaagacacggctgtgtattactgtgcgagaggctatcactatggttc

SEQ ID NO: 465449 - DNA, 544 bp, Homo sapiens
  misc_feature: HEFZJCU01ADAWD.18.14.B03.1.454.heavy.3.raw
tacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgcaaatgaacagcctgaaaaccgaggacacggccgtgtattactgtaccacatcccctgaaagcgtcaactactactactacggtatggacctctggggccaagggaccacggtcaccgtctcctcagcctccaccaagggcccatcggtcttccccctcggcgccctgcctccacggagcacctccgagagcacagcggtcccg

SEQ ID NO: 465450 - DNA, 494 bp, Homo sapiens
  misc_feature: HEFZJCU01CGK0V.4.75.G09.1.454.heavy.3.raw
  modified_base (480)..(480): a, c, t, g, unknown or other
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaaccaggtggtccttacaatgaccaacatggaccctgtggacacagccacatattactgtgcacagagatacgggcagcacgtggtttggggctactggggccagggaaccctggtcacgtcncctcagcctcaccg

SEQ ID NO: 465451 - DNA, 533 bp, Homo sapiens; identical to SEQ ID NO: 452106
  misc_feature: HEFZJCU01D4CNO.17.28.C06.1.454.heavy.3.raw
  modified_base (522)..(522): a, c, t, g, unknown or other

SEQ ID NO: 465452 - DNA, 505 bp, Homo sapiens
  misc_feature: HEFZJCU01EFT93.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgcgttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttccccctggcgccctcgctccacggagcacctccgagagcacagcggccctgggctgcctggtcaaggactacttcccacta

SEQ ID NO: 465453 - DNA, 525 bp, Homo sapiens
  misc_feature: HEFZJCU01B7QRW.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccaccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggttctacttcgatctctggggccgtc

SEQ ID NO: 465454 - DNA, 514 bp, Homo sapiens
  misc_feature: HEFZJCU01EJOYY.12.71.G05.1.454.heavy.3.raw
  modified_base (463)..(463): a, c, t, g, unknown or other
  modified_base (480)..(480): a, c, t, g, unknown or other
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctgggccagggaacccaggtcaccgtctcctcagcctccaccaagggcccatccgtcttcccctgcgccctgctccagngcacctccgagagcacngcgcctgggctgcctggtcaggactactcctacg

SEQ ID NO: 465455 - DNA, 508 bp, Homo sapiens; identical to SEQ ID NO: 445594
  misc_feature: HEFZJCU01CG15A.17.25.C03.1.454.heavy.3.raw

SEQ ID NO: 465456 - DNA, 504 bp, Homo sapiens
  misc_feature: HEFZJCU01BI6W9.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctctaacacctatggcatctcctgggtgcgacaggcccctggacaaggacttgagtgggtggggtgggtcagcgcttaccaagttggctacacaaattatgcacagaaagttccaggacagagtcaccatgaccacagacacatccacgagcacagcctacatggaactgaggagcctgagatctgacgacacggccgtatatttctgcgcgagagacgtaaaagtgacgtggtattccggggggacacatgacc

SEQ ID NO: 465457 - DNA, 513 bp, Homo sapiens
  misc_feature: HEFZJCU01EK0AM.21.34.D01.1.454.heavy.3.raw
tcgtcgctcgcacgaccggtgctcgatttagatcgtctgtgttgggtttgggggaggcttggtccagcctggggggtccctgagagtctcctgtgtggcctctggattcaagtttaatacctattggatgagctgggtccgccaggctccagggaaggggctggagtgggtggccaacataaaggaagatggaagtgacaaaaagtatgtggactctgtgaagggccgattcaccatcttcagagacaacgccaagaactcactttatctgcaaatgaatagcctgagagtcgaagacacggctgtgtattactgtgcgagagatagcgaggaggtggagcagctcgtcgatttgtactacatggacgtctggggcaaagggaccacggtcaccgtctcctcagcctccaccaagggcccatcggtcttcccctggccaccctcctccaagagcacctctgggggcacagcggccctgggctgcctggtcaaggactacttcccgagcgacga

SEQ ID NO: 465458 - DNA, 482 bp, Homo sapiens
  misc_feature: HEFZJCU01C831Q.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttccccctggcgccctgctccaggagcaccctccgagagcacagcggccctgggctgcctggtcaaggactacttccagacgtatca

SEQ ID NO: 465459 - DNA, 516 bp, Homo sapiens
  misc_feature: HEFZJCU01CIJU3.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgctttgtttggagtcttttgacttacgtggggccagggaaccctggtcatcgtctcctcagcctccaccaacggcccatcggtccttcccctcggccaccctccctccaagagcacctcgtgggggcacagcggcccgtgggctgcctggtcaaggactacttccgagtagtaca

SEQ ID NO: 465460 - DNA, 517 bp, Homo sapiens
  misc_feature: HEFZJCU01AXKH3.14.14.B03.1.454.heavy.3.raw
cgtctagtaccacgaccggtgctcgatttagtgtgagtagtttgggctgagctgggtcttccttgttgctattataaaaggtgtccagtgtcaagtgcagttggtggagtctgggggaggcttggtcaagcctggagggtccctgagactctcctgtgcagcctctggattcaccttcagtgactactacatgacctggatccgccaggcgccagggaaggggctggaatggattgcatacattcactatagtggaaatgcagtgtcctacgcagactctctgaagggccgattcaccgtctccagggacaacggccaagaactcgctgtatctgcaaatcgacggcctgagagtcgaggacacggccatgtattactgtgcgagagtgtggttcggtcatgttttagaagttggggcttttgaccactggggccagggaaccctggtcacgtctcttcagcctcaccaagggcccatcggtcttccccctggcaccctcctccaagagcacctctc

SEQ ID NO: 465461 - DNA, 488 bp, Homo sapiens
  misc_feature: HEFZJCU01BUHX8.19.13.B02.1.454.heavy.3.raw
  modified_base (422)..(422): a, c, t, g, unknown or other
tactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatggcatgcactgggtccgccaggctccgaggcaaggggctggagtgggtggcagttatatcatatgatggaagtaataaatactatgcagactccgtgaagggccgattcaccatctccagagacaattccaagaacacgntgtatctgcaatgaacagcctgagagctgaggacacgggctgtgtattactgtcgcgaggcggtaa

SEQ ID NO: 465462 - DNA, 507 bp, Homo sapiens
  misc_feature: HEFZJCU01DFC8B.5.6.A06.1.454.heavy.3.raw
atcagacacgcacgaccggtgctcgatttagatctactgacaggggtctcagagaggtgccttagccctggattccaaggcatttccacttggtgatcagcactgaacacagaggactcaccatggagttggggctgcgctgggttttccttgttgctattttagaaggtgtccagtgtgaggtgcagctggtggagtctgggggaaagttggtgcagcctggggagtccctgagactctcctgtgaaggcgctggatttaccctcagttcctataaaatgggctgggtccgccaggctccagggaaggggctggagtggctttcaatcatctacagtagtgggagtgtcatttatacgcggactctgtgaagggccgattcaccatttccagagacaacgccaagaactcactgtatctgcaatgaacagcctgagagccgaggacacggctgtagtattactgtgcgagagatctgggggccaacagttggccctactttgtacg

SEQ ID NO: 465463 - DNA, 525 bp, Homo sapiens
  misc_feature: HEFZJCU01D1KOF.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccatggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatccggtccttccccctggccg

SEQ ID NO: 465464 - DNA, 463 bp, Homo sapiens; identical to SEQ ID NO: 459359
  misc_feature: HEFZJCU01ALVWF.19.10.A10.1.454.heavy.3.raw

SEQ ID NO: 465465 - DNA, 499 bp, Homo sapiens; identical to SEQ ID NO: 453198
  misc_feature: HEFZJCU01DJEFM.11.71.G05.1.454.heavy.3.raw

SEQ ID NO: 465466 - DNA, 522 bp, Homo sapiens
  misc_feature: HEFZJCU01CDZDD.16.39.D06.1.454.heavy.3.raw
tgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctgggggaggcttggcacagccgtggggggtccctgagactctcctgtgcagcctctggattcacctttgacagctatgccatgacctgggtccgccaggctccagggaagggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagccaaccggcagttagtcaccctatactactttgacctac

SEQ ID NO: 465467 - DNA, 502 bp, Homo sapiens
  misc_feature: HEFZJCU01DWKAP.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttcccctggcaccctcctccaagagcacctctgggggcacagcggcctgggctgcctggtcaaggactactcctacgtcgtat

SEQ ID NO: 465468 - DNA, 512 bp, Homo sapiens; identical to SEQ ID NO: 445688
  misc_feature: HEFZJCU01C4VB1.3.34.D01.1.454.heavy.3.raw

SEQ ID NO: 465469 - DNA, 521 bp, Homo sapiens
  misc_feature: HEFZJCU01ER0VJ.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggcccttcacagggcggtttgtcttctccatggatacctctgtcgggacggcttatctgcagataaccaaccttcaacctgacgacactgccgtttattttgtacgtagagcgtcgtctgtcagtggaattgactactgggccagggaaccctggtcaccgtctcctcagcc

SEQ ID NO: 465470 - DNA, 494 bp, Homo sapiens
  misc_feature: HEFZJCU01DXQT3.49.65.F10.1.454.heavy.3.raw
agtcgagagacacgaccggtgctcgatttagctacgctctaaggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgaagcctctggattcaccttcaagaactttggcatgcactgggtccgccaggctccaggcacggggctggagtgggtggcagttatctcagatgatggaagtaaaaagtactattcggactccttgaagggccgattcaccatctccagagacaattccaagaacaccttgcatctacaaatgcacagtctgagacctgaggacacggctgtgtattactgtgcgaagggggaggggagtttttgc

SEQ ID NO: 465471 - DNA, 506 bp, Homo sapiens
  misc_feature: HEFZJCU01AH6UR.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttcccctggcgccctgctccaggagcacctccgagagcacagcggccctgggctgcctgtcaaggactactccgagtgcgtct

SEQ ID NO: 465472 - DNA, 450 bp, Homo sapiens
  misc_feature: HEFZJCU01DA6DF.48.62.F07.1.454.heavy.3.raw
agtatacatacacgaccggtgctcgatttagtagtcgcataaagggaaagggcgccagatggtccttcctcgtgagtcccaggaccaccctcggcctctgggtccagagtccaacaacccccgggccctccccggcctcaacctgagagagattcccagggacgttttccctggggtcctgacattgttgtcacaatgtgacaactgagtcgacccctggggccagagaaccctggtcaccgtctcctcagggtgaggatggacattccgccactgtgatcacttccactactgcggtatggacgtctggggccaagggaccacggtcaccgtctcctcagcttccaccaagggcccatcggtcttccccctggcgccctgctccaggagcacctctgggggcacagcggccctgggctgcctggtcaaggactacttcctatgtatact

SEQ ID NO: 465473 - DNA, 536 bp, Homo sapiens
  misc_feature: HEFZJCU01DJPUM.51.26.C04.1.454.heavy.3.raw
cgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtctggggccaagggaccacggtcaccgtctccttagcctccaccaagggcccatccggtcttcccctggccaccctcctccaagagccaccctctc

SEQ ID NO: 465474 - DNA, 516 bp, Homo sapiens
  misc_feature: HEFZJCU01B59L6.4.25.C03.1.454.heavy.3.raw
agcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgtttctgcaaatgaacagcctgagagccgaggacacggctgtgtatcactgtgtcagagatgccgagggcggttacccctctggttccttcgacagttatggtatggacgtctggggcctaggggactacggtcaccgtctcctcagcctccaccaagggcccatcggtcttccccctggcta

SEQ ID NO: 465475 - DNA, 513 bp, Homo sapiens
  misc_feature: HEFZJCU01AYMCT.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtggcgttttctagtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactgggggaccg

SEQ ID NO: 465476 - DNA, 487 bp, Homo sapiens; identical to SEQ ID NO: 446769
  misc_feature: HEFZJCU01EXGWC.22.86.H09.1.454.heavy.3.raw

SEQ ID NO: 465477 - DNA, 492 bp, Homo sapiens
  misc_feature: HEFZJCU01A1IXS.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctcccagagacaattcccagaacacggtctatctgcacctgaccagcctgagaactgacgacacgtctctctactactgtgcgagagagttgacgagt

SEQ ID NO: 465478 - DNA, 478 bp, Homo sapiens
  misc_feature: HEFZJCU01BB4W7.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagaagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagaggcccc

SEQ ID NO: 465479 - DNA, 501 bp, Homo sapiens; identical to SEQ ID NO: 447719
  misc_feature: HEFZJCU01CR009.17.10.A10.1.454.heavy.3.raw

SEQ ID NO: 465480 - DNA, 495 bp, Homo sapiens; identical to SEQ ID NO: 458413
  misc_feature: HEFZJCU01CWPD8.52.85.H08.1.454.heavy.3.raw

SEQ ID NO: 465481 - DNA, 527 bp, Homo sapiens
  misc_feature: HEFZJCU01BH4Q4.12.40.D07.1.454.heavy.3.raw
atacgacgtacacgaccggtgctcgatttagtgatagagcgtaacaacagagggctcaccatggagtttgggctgagcgtgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccagggcccatcggtcttcccctggccgcctcg

SEQ ID NO: 465482 - DNA, 406 bp, Homo sapiens
  misc_feature: HEFZJCU01AO17Q.12.58.F03.1.454.heavy.3.raw
atacgacgtacacgaccggtgctcgatttagtctgatcgagaagggaaaggggctggagtgggtggccaatatacagtcaggtggaggtacgatacactatctcgactctgtgaagggccggttcaccatctccagagacaacgccaagaattcactgtatctgcaaatgaacagcctgagagtcgaagacacgggtatttattattgtgtgcgagatctggatttccttcgaaatgaagtgtggttcgatgtgtttgatctttggggccaagggacaattgtcaccgtctcttcagcctccaccaagggcccatcggtcttccccctggcgccctgctccaggagcacctccgagagcacagcggccctgggctgcctggtcaaggactacttcctacgtcgtat

SEQ ID NO: 465483 - DNA, 371 bp, Homo sapiens; identical to SEQ ID NO: 444919
  misc_feature: HEFZJCU01DIMAK.3.1.A01.1.454.heavy.3.raw

SEQ ID NO: 465484 - DNA, 490 bp, Homo sapiens; identical to SEQ ID NO: 448082
  misc_feature: HEFZJCU01EP4PX.47.85.H08.1.454.heavy.3.raw

SEQ ID NO: 465485 - DNA, 525 bp, Homo sapiens
  misc_feature: HEFZJCU01BCAU0.40.56.F01.1.454.heavy.3.raw
tctagcgactcacgaccggtgctcgatttagcagacgtctgaacacacaaagggggtgctttctgagagtcatggacctcctgcacaaaaacatgaaacacctgtggttcttcctcctcctggtggcagctcccagatgggtcctgtcccagccgcagctacagcagtggggcgcgggactgttgaagccttcggagaccctgtccctcacctgcgctgtcaatggtgagtcctttggtggttatcactggagctggatccgccagtctccccggaggggcctggagtggattggcgaaatcaatcatcgtgaaatcaccaactacaacccgtccctcaagagtcgaatcagtatttctgtagacacgtccaagaagcaattctccctgatgatgagttctctgaccgccgcggacacggctgtgtatttctgtgcgagccaacatgaaggcatttgggggagttatggaccctttgagtagttgggggtccaggggaggtccgtgggtccaccggtctccgtcc

SEQ ID NO: 465486 - DNA, 508 bp, Homo sapiens; identical to SEQ ID NO: 451448
  misc_feature: HEFZJCU01C06O5.14.85.H08.1.454.heavy.3.raw

SEQ ID NO: 465487 - DNA, 373 bp, Homo sapiens; identical to SEQ ID NO: 445918
  misc_feature: HEFZJCU01AJY1T.49.30.C08.1.454.heavy.3.raw

SEQ ID NO: 465488 - DNA, 508 bp, Homo sapiens
  misc_feature: HEFZJCU01DSJX2.51.65.F10.1.454.heavy.3.raw
cgatcgtatacacgaccggtgctcgatttagctacgctctaagggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggattaattccaaaagtggtggcacaaagactgcacagaagtttcagggcagggtcaccatgaccagggacaagtccaccaacacagcctacatggaactaaggggactgacatctgacgacacggccatgtattattgtgcgagagaaatgttaggtactgctttggtccctgggggcccgggaacccggggtc

SEQ ID NO: 465489 - DNA, 472 bp, Homo sapiens; identical to SEQ ID NO: 445355
  misc_feature: HEFZJCU01ADEKU.4.37.D04.1.454.heavy.3.raw

SEQ ID NO: 465490 - DNA, 427 bp, Homo sapiens; identical to SEQ ID NO: 444708
  misc_feature: HEFZJCU01B568E.9.34.D01.1.454.heavy.3.raw

SEQ ID NO: 465491 - DNA, 500 bp, Homo sapiens
  misc_feature: HEFZJCU01DCNV6.10.26.C04.1.454.heavy.3.raw
catagtagtgcacgaccggtgctcgatttagtctagcgactttgggtttggggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaagtcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaa

SEQ ID NO: 465492 - DNA, 504 bp, Homo sapiens
  misc_feature: HEFZJCU01CF65I.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggttgaactactggggccagggcaccctggtcaccgtctcctcagcttccaccaaggcccatcggtcttcccctggcgcctgctccagagcacctctggggcacagcgccctgggctgcctgtcaaggactactcccat

SEQ ID NO: 465493 - DNA, 496 bp, Homo sapiens
  misc_feature: HEFZJCU01EFAOB.4.25.C03.1.454.heavy.3.raw
agcactgtagcacgaccggtgctcgatttagtagtgtagatttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgtttctgcaaatgaacagcctgagagccgaggacacggctgtgtatcactgtgtcagagatgccgagggcggtta

SEQ ID NO: 465494 - DNA, 550 bp, Homo sapiens
  misc_feature: HEFZJCU01DAQ03.13.28.C06.1.454.heavy.3.raw
tcacgtactacacgaccggtgctcgattagagctcacgtattgggtttggggaggtctcagagaggagccttagccctggactccaaggcctttccacttggtgatcagcactgagcacagaggactcaccatggaattgggtctgaactgggttttccttgttgctattttagaaggtgtccagtgtgaagtgcacctggtggagtccgggggagacttggtccagcctggggggtccctgagactctcctgtgtagcctctggatttgtttttagtgactattggatgagttgggtccgccaggctccagggaaggggctggagtgggtgaccaacataaagtacgatgaagttgagataaattatttggactctgtgaagggccgattcaccatctcgagggacaacgccaagaactcgctgtatctgcaaatggagagcctgagagccgaggacacggtctgtatattagttgtgtgagtattagcgctaacttactttagaactacggtcggggtccgaacgggtaacccgttggtcctaccgtt

SEQ ID NO: 465495 - DNA, 507 bp, Homo sapiens
  misc_feature: HEFZJCU01B5HB5.49.53.E09.1.454.heavy.3.raw
agtcgagagacacgaccggtgctcgatttagagagagtgtgttgggtttgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctggggcccagggagccctggtccaccgtctcctcagcttccacaagggccatcggtcttcccctggcgccctgctccaggagcacctctgggggcacgagcggccctgggctgcctggtcaaggactacttcctctctcg

SEQ ID NO: 465496 - DNA, 500 bp, Homo sapiens; identical to SEQ ID NO: 445080
  misc_feature: HEFZJCU01DQXQ9.3.81.H04.1.454.heavy.3.raw

SEQ ID NO: 465497 - DNA, 522 bp, Homo sapiens
  misc_feature: HEFZJCU01BL8C7.7.71.G05.1.454.heavy.3.raw
cgtgtctctacacgaccggtgctcgatttagtgtcgtcgcaagagagaggggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccgagcgggagttccaagtactcctttgacgtctc

SEQ ID NO: 465498 - DNA, 506 bp, Homo sapiens
  misc_feature: HEFZJCU01EV11V.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaaggcccatcggtcttcccctggcaccctcctccaagagcacctctgggggcacagcggcccgtgggctgcctggtcaaggactacttccgagtagtaca

SEQ ID NO: 465499 - DNA, 509 bp, Homo sapiens
  misc_feature: HEFZJCU01ERWTP.53.34.D01.1.454.heavy.3.raw
cgcgtatacacacgaccggtgctcgatttagatcgtctgtgttgggtttggggctgggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttggtccagcctggggggtccctgagactctcctgtgcagcctctggattgaccgtcagtagcaactacatgagctgggtccgccaggccccagggaaggggctgggagtgggtctcaacaatttatagcggtggtaggacataccacgcagaccccgtgaagggccgattcaccatctccagacacaattccaagaacacactgtttcttcaaatggacttcctgagaactgaggacacggccgtgtattactgcgcgagagtgcatgatagtggtttccatgatgtcttttg

SEQ ID NO: 465500 - DNA, 496 bp, Homo sapiens
  misc_feature: HEFZJCU01EQ2R0.51.86.H09.1.454.heavy.3.raw
  modified_base (343)..(343): a, c, t, g, unknown or other
  modified_base (370)..(370): a, c, t, g, unknown or other
  modified_base (487)..(487): a, c, t, g, unknown or other
cgatcgtatacacgaccggtgctcgatttagtgctatagacttgggtttggggagctctgggagacgagcccagcactggaagtcgccggtgtttccattcggtgatcatcaccgaacacagaggactcaccatggagtttggactgagcgtggttttcgtcgttaggctcttttaagaggtgtccagtgtcaggtgcagctggtggactctgggggaggcgtggtccagcctgggaggtccctgagactctcctgtgcagcctctggattcaccttcaatacttatggcatgcactgggtccgccaggctccaggcaaggggctggagtggctgtcctttanctcatatgatggaggcaataaaaattntgcagactccgtgaagggccgattcaccatctccagagacaatttccaagaacactctatatttgcagatgaataagcctgagaattgaggacacggctgtgtattactgtgtgagngggtcggct

SEQ ID NO: 465501 - DNA, 524 bp, Homo sapiens; identical to SEQ ID NO: 452359
  misc_feature: HEFZJCU01EJH14.12.33.C11.1.454.heavy.3.raw

SEQ ID NO: 465502 - DNA, 520 bp, Homo sapiens
  misc_feature: HEFZJCU01DSDVS.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccaggggcagagtcaccattaccgcggacgaggccacgaagacagtctacatggaattgagcagcctgagatttgacgacacggccatgtattactgtgcgagggagggccagctgctgggagcgtctacatatttcgaccctgggccagggaacccaggtcaccgtctcctcagcctccaccaagggcccatccgtcttcccctggcgccctgctccaggacgcaccctccgagagcacagcggccctgggctgcctggtcaggactactctaccg

SEQ ID NO: 465503 - DNA, 523 bp, Homo sapiens
  misc_feature: HEFZJCU01CE1KE.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcctttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacacccttttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttccccctggcg

SEQ ID NO: 465504 - DNA, 517 bp, Homo sapiens; identical to SEQ ID NO: 446608
  misc_feature: HEFZJCU01COMJ0.9.34.D01.1.454.heavy.3.raw

SEQ ID NO: 465505 - DNA, 485 bp, Homo sapiens
  misc_feature: HEFZJCU01AWBP7.3.75.G09.1.454.heavy.3.raw
agacgcactccacgaccggtgctcgatttagtatagacatcaggggacactgagtgtgagtgaacatgagtgagcaaaactggatttgtgtgccattttctgataacggtgtccttctgtttgcaggtgtccagtgtcaggtgcagctggtgcagtcggggggaggcgtggtccagcctgggaggtccctgagactctcctgtgcagcctctggcttcatcttcagtagctataaaatgcactgggtccgccaggctccaggcaaggggctggagtgggtggcacttatttcatatgatggaaggaacagatacttcgcagactccgtgaagggccgagtcaccatctccagagacaattccaagaacacggtgtctctgcaagtgaatagcctgagacgtgacgacacggctgtgtattactgtgcgagagagggtttcgcagctcgtccggcgggcccagttgaacatgactatcactactac

SEQ ID NO: 465506 - DNA, 509 bp, Homo sapiens
  misc_feature: HEFZJCU01CIZZR.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaaggcccatcggtcttcccctggcgccctgctccaggagcacctccgagagcacagcggccctgg

SEQ ID NO: 465507 - DNA, 475 bp, Homo sapiens
  misc_feature: HEFZJCU01BUAVJ.52.8.A08.1.454.heavy.3.raw
cgcagtacgacacgaccggtgctcgatttagcatactctacaggggctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagcgtgaagacacggctgtatattactgtgcgaactt

SEQ ID NO: 465508 - DNA, 492 bp, Homo sapiens
  misc_feature: HEFZJCU01EAP2H.51.69.G03.1.454.heavy.3.raw
cgatcgtatacacgaccggtgctcgatttagtcgctgcgtaaaggagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagcctggggcctcagtgaaggtctcctgcaagacttctggatacaccttcaccgactactatatgcactgggtgcgacaggcccctggacaagggcttgagtggatgggatggatcgaccctaagaatggtgccacaaactatgcacagacttttcagggctgggtcaccatgaccagcgacacatctagcaacacagtctacatggagttgaccagcctgaccgacacggccgtgttatttttgtgtgagagtattttcggactaatccagagacccctgt

SEQ ID NO: 465509 - DNA, 504 bp, Homo sapiens
  misc_feature: HEFZJCU01EBDWN.49.30.C08.1.454.heavy.3.raw
agtcgagagacacgaccggtgctcgatttagtctgacgtcaaagggaaagggggggagacgagcccagcactggaagtcgccggtgtttccattcggtgatcatcactgaacacagaggactcaccatggagtttgggctgagctgggttttcctcgttgctcttttaagaggtgtccagtgtcaggtgcttctggtggactctgggggaggcgtggtccggcctgggaggtccctgagactctcctgtgcagcctctcagttcaccttcagtgtctatactatgcactgggtccgccaggctccaggcaaggggctggagtgggtggcacttatatcaaatgatggaagaattcaacactacgcaggctccgtgaagggccgattcaccatctccagagacaattccaagaacacactgtctctgcaaatgaatagcctgagagttgaggacacggctgtctattactgtgcgagagctaagggacttactcatagatttgta

SEQ ID NO: 465510 - DNA, 525 bp, Homo sapiens; identical to SEQ ID NO: 450208
  misc_feature: HEFZJCU01CG9QX.3.82.H05.1.454.heavy.3.raw

SEQ ID NO: 465511 - DNA, 502 bp, Homo sapiens
  misc_feature: HEFZJCU01ET7I7.48.55.E11.1.454.heavy.3.raw
agtatacatacacgaccggtgctcgatttagcactcgcacgttgggtttggggagctctcagagaggtgccttagccctggattccaaggcatttccacctggtgatcagcactgaacacagaggactcaccatggaggtggggctgtgctgggtgttccttgttgctattttagaaggtgtccaatgtgaggtgcagctggtggaatctgggggtgccttggtgccgccgggggggtccctgagactctcctgtgtagcctccggattcacatttagttcccatagtatggtctgggtccgccaggctccagggaagggtctagagtggatttcatacattaggagtggcagtagtcccatatactacgcagactctgtgaagggccgattcatcatctccagagacaatgccgagaactcactgttctgcaaatgaacagcctgagagacgaggacacggctgtttattactgtgcgagagtgcggatttcacctacacg

SEQ ID NO: 465512 - DNA, 477 bp, Homo sapiens
  misc_feature: HEFZJCU01D7EIH.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctattttggccgcggccgactactggggccagggcaccctggtcaccgtctcttcagcctccaccaagggcccatcggtcttcccctggcgccctgctccaggagcacctccgagagcacagcggccctgggctgcctggtcaaggactactccacgcgtatgt

SEQ ID NO: 465513 - DNA, 516 bp, Homo sapiens
  misc_feature: HEFZJCU01BBJPG.10.53.E09.1.454.heavy.3.raw
catagtagtgcacgaccggtgctcgatttagagagagtgtgttgggtttgggggagacgagcccagcactggaagtcgccggtgtttccattcgttgatcatcactgaacacagaggactcaccatggagtttgggctgagctgggttttcctcgttgctcttttaagaggtgtccagtgtcaggtgcagctggtggagtctgggggagcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcgtcgggggaataccttcagcactggggccac

SEQ ID NO: 465514 - DNA, 490 bp, Homo sapiens
  misc_feature: HEFZJCU01C9OPH.49.59.F04.1.454.heavy.3.raw
agtcgagagacacgaccggtgctcgatttagtacacacacttagggattggggtctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaatgaacagtctgagacgtgaagacacggctgtctattactgtgcgactgagatgtcttt

SEQ ID NO: 465515 - DNA, 511 bp, Homo sapiens
  misc_feature: HEFZJCU01EX0XE.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccgggcagtttagtcacccataacctactttgactactgggg

SEQ ID NO: 465516 - DNA, 521 bp, Homo sapiens
  misc_feature: HEFZJCU01B2PUW.40.28.C06.1.454.heavy.3.raw
tctagcgactcacgaccggtgctcgatttagagctcacgtattgggtttggggggaagaggaagactgacggtccgtgccgacagggtggccactcccaggtccactttgtgcagtctggggctgaggtgcagaagcccggggcctcagtgacgatttcctgcaaggcttctggatacagcttcagtagttatgctatacagtgggtgcgccaggcccccggacaaaggcttgagtggctgggatggatcgtcggtggcactcctaacataagatattcacagaagtttcagttcagagtcacctttagcagcgacacatccgcgacgacagtctacatggagttgagtggcctaagatctgaagacacggctgtctattactgtgcgagagatgccttacacgacgagggggcccactttgattactggggccagggaaccctggtcaccgtctcctcagcctccaccaagggcccatcggtcttccccctggcgccctgctccaggagcacctccgacg

SEQ ID NO: 465517 - DNA, 518 bp, Homo sapiens
  misc_feature: HEFZJCU01DU0XQ.51.77.G11.1.454.heavy.3.raw
cgatcgtatacacgaccggtgctcgatttagctagtcactcaagggaaaggggcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatttcatatgatggaagtaaaatattctatgtagactccgtgaagggccgcttcatcatctccagagacaattcccagaacaccctgtttctgcaaatgcacagcctgagacctgaggacacggctgtgtattactgtgcgaacttaatcacggaggacaacggtgacccccgtccgctcggtgcggaggtctggggccaagggaccacggtcatcgtctcctcagcctccaccaagggcccatcggtcttcccctggcaccctcctccaagagcacctctgggggcacagcggccctgggctgcctggtcaaggactacc

SEQ ID NO: 465518 - DNA, 492 bp, Homo sapiens
  misc_feature: HEFZJCU01DQLXP.10.21.B10.1.454.heavy.3.raw
catagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccgacctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacggggtgtttattactgtgggaagaaatcctaa

SEQ ID NO: 465519 - DNA, 521 bp, Homo sapiens
  misc_feature: HEFZJCU01CXGH9.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtcgtggggccaagggacccg

SEQ ID NO: 465520 - DNA, 533 bp, Homo sapiens
  misc_feature: HEFZJCU01DWEJE.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggcccggggaaccctggtccaccgtcctccccaccctccaaccg

SEQ ID NO: 465521 - DNA, 371 bp, Homo sapiens; identical to SEQ ID NO: 444435
  misc_feature: HEFZJCU01ETB3I.3.42.D09.1.454.heavy.3.raw

SEQ ID NO: 465522 - DNA, 511 bp, Homo sapiens
  misc_feature: HEFZJCU01BTDMV.4.75.G09.1.454.heavy.3.raw
  modified_base (419)..(419): a, c, t, g, unknown or other
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctggacctgcaccttctctgggttctcactcagcactagcggagtgggtgtgggctggatccgtcagcccccaggaaaggccctggagtggcttgcactcatttattgggatgatgataaggcgctacagcccatctctgatgaacaggctcaccatcaccaaggacgcctccaaaaaccaggtggtccttacaatgaccaacatggaccctgtggacacagccacataatttacngtgcacagagatacgggcagcacgtggtttggggcgtactgggggccaggggaaccctggtccaccgttctccgtcaggccctccgaacccg

SEQ ID NO: 465523 - DNA, 315 bp, Homo sapiens; identical to SEQ ID NO: 444422
  misc_feature: HEFZJCU01BIXIZ.47.84.H07.1.454.heavy.3.raw

SEQ ID NO: 465524 - DNA, 499 bp, Homo sapiens
  misc_feature: HEFZJCU01CM1M8.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagatttctatagaggtgactacggggggcgttcg

SEQ ID NO: 465525 - DNA, 545 bp, Homo sapiens
  misc_feature: HEFZJCU01ESVUT.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacgggccgtgtattactgtgcgagacgacccctccgatagcaggtggctggtccacgttaggtttgacttacgtgggggcccaaggggaagtcgtttgggtccaccggtcctcctcacgccctacccg

SEQ ID NO: 465526 - DNA, 508 bp, Homo sapiens
  misc_feature: HEFZJCU01C8MNR.48.81.H04.1.454.heavy.3.raw
agtatacatacacgaccggtgctcgatttagtagtgtagattcgcgggggagcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcgcggggaggtggacggagctcggttttcggagtttatcatctactacttt

SEQ ID NO: 465527 - DNA, 523 bp, Homo sapiens
  misc_feature: HEFZJCU01E1H79.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcggtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagaccttaccatgaccacgaactcctccataaacacagcctacatggagttggaggagcctgacatctgacgacacggccgtcttattactgtgcgagagtccccacgatccgggtgacgccgtacggcaggcggtccctttgacctttcgtcggggccg

SEQ ID NO: 465528 - DNA, 483 bp, Homo sapiens
  misc_feature: HEFZJCU01DG50S.47.59.F04.1.454.heavy.3.raw
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcgggctcagcctccaccaagggcccatcggtcttcccctggcgccctgctccaggagcacctccgagagcacagcggccctgggctgcctggtcaaggactacttcctacgtgagct

SEQ ID NO: 465529 - DNA, 520 bp, Homo sapiens
  misc_feature: HEFZJCU01DK2XO.2.81.H04.1.454.heavy.3.raw
acgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggtttacttgttggtatttagaaggtgtccagtgtgaggtgcagctggtggagtccgggggaggctgggtccagcctggggggtccctgagactctcctgttcagcctctggattcacctttagtaggttttggatgagttgggtccgccaggctccagggaaggggctggagtgggtggccaacatagagtacgatggaagtgaagaaaactatgtggactccgtgaagggccgattcaccatctccagagacaaacgacaagaatttagtgtatctgcaaatgagcagcctgagagcgaggacgacggctgtgtattattgtgcgag

SEQ ID NO: 465530 - DNA, 510 bp, Homo sapiens
  misc_feature: HEFZJCU01AZSNF.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtgcgttttctaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaagggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccg

SEQ ID NO: 465531 - DNA, 500 bp, Homo sapiens; identical to SEQ ID NO: 450218
  misc_feature: HEFZJCU01BW7MQ.17.10.A10.1.454.heavy.3.raw

SEQ ID NO: 465532 - DNA, 532 bp, Homo sapiens; identical to SEQ ID NO: 449262
  misc_feature: HEFZJCU01CMSB8.7.78.H01.1.454.heavy.3.raw

SEQ ID NO: 465533 - DNA, 509 bp, Homo sapiens; identical to SEQ ID NO: 447939
  misc_feature: HEFZJCU01AZ7ZW.17.25.C03.1.454.heavy.3.raw

SEQ ID NO: 465534 - DNA, 534 bp, Homo sapiens; identical to SEQ ID NO: 446321
  misc_feature: HEFZJCU01DM6GD.22.38.D05.1.454.heavy.3.raw

SEQ ID NO: 465535 - DNA, 502 bp, Homo sapiens
  misc_feature: HEFZJCU01BDNMJ.13.87.H10.1.454.heavy.3.raw
tcacgtactacacgaccggtgctcgatttagcagtactgcgttgggtttggggagctctgggagaggagccccagccctgagattcccaggtgtttccattcagtgatcagcactgaacacagaggactcaccatggagttggggactgagcgtggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcgggactctgtgaagggccgattcaccatctccagagacaacgccaagaactccctgtatctgcaatgaacagcctgagagctgaggacacggccttgtattatgtgcaaagatccaaccccttacgtt

SEQ ID NO: 465536 - DNA, 481 bp, Homo sapiens
  misc_feature: HEFZJCU01ERWCK.19.71.G05.1.454.heavy.3.raw
  modified_base (430)..(430): a, c, t, g, unknown or other
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctcctgcagctgacctntgtgactcccgaggacacgggtgtatattactgtggaagacgccccatacg

SEQ ID NO: 465537 - DNA, 524 bp, Homo sapiens
  misc_feature: HEFZJCU01C9O7E.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaaggcctggagtggattgggaacatctattacagcgggagcaccaactacaacccgtccctcaagagtcgagttaccatttcattaaaacacgtctaagaaccagttcctccctgaagctgacctttgtgactgccgcggacacggccgtgtattactgtgcgagagacccctccgatagcagtggctggtccacgtaggtttgactactgggggccagggaagcttggtcaccgtctccgtcagcct

SEQ ID NO: 465538 - DNA, 487 bp, Homo sapiens
  misc_feature: HEFZJCU01A53SX.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtctcccctggcgccctgctccaggagcacctccgagagcacagcgccctggctgcctgtcaaggactacttcccacgagagta

SEQ ID NO: 465539 - DNA, 509 bp, Homo sapiens
  misc_feature: HEFZJCU01AV651.14.71.G05.1.454.heavy.3.raw
cgtctagtaccacgaccggtgctcgatttagtgtcgtcgcaagagagaggagcccagccctgggattttcaggtgttttcattcggtgatcaggactgaacagagagaactcaccatggagtttgggctgagctggctttttcttgtggctattttaaaaggtgtgcagtgtgaggtgcagctgttggagtctgggggaggcttggtacagcctggggggtccctgagactctcctgtgcagcctctggattcgtctttagcagctatgccatgagctgggctcgccaggctccagggaaggggctggagtgggtctctgctattcctggcagtggtgatatcgaatactacgcagactccgtgaagggccggttcactgtttccagagacaattccaagaacacactgtatctgcagatgaccagcctgagagccgaggacacgggccgtatattactgtgcgaaacgccaagatttttggagtgggttattataccttttgacttcg

SEQ ID NO: 465540 - DNA, 491 bp, Homo sapiens
  misc_feature: HEFZJCU01CV4YG.51.71.G05.1.454.heavy.3.raw
cgatcgtatacacgaccggtgctcgatttagtgtcgtcgcaagagagaggggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaaggccgattgaccatctccagagacaactcgaagaatacggttcttctacaaatgaacagcctgagagctgaggacacggctatgttttactgtgcgagagggaactcgattacagcag

SEQ ID NO: 465541 - DNA, 482 bp, Homo sapiens; identical to SEQ ID NO: 444503
  misc_feature: HEFZJCU01B3NE7.7.10.A10.1.454.heavy.3.raw

SEQ ID NO: 465542 - DNA, 513 bp, Homo sapiens
  misc_feature: HEFZJCU01CA9CJ.53.76.G10.1.454.heavy.3.raw
cgcgtatacacacgaccggtgctcgatttagtcactcatacagggggagtctccctcactgcccagctgggatctcagggcttcattttctgtcctccaccatcatggggtcaaccgccatcctcgccctcctcctggctgttctccaaggagtctgtgccgaggtgcagctggtgcagtctggaacagaggtgaaaagccgggggagtctctgaagatctcctgtaagggttctggatacaactttaccacctactggatcgcctgggtgcgccagatgcccggaaaaggcctggagtggatgggcatcgtcaatcctagtgactctgaagccacatacagcccgtccttccaaggccaggtcaccctctcagccgacaagtccatcagcgccgccttcctgcagtggcgcggcctggaggcctcggacaccggccacatattactgtgcgagacttacatttggggggagtttatcgttgtttcctccactgggtgctttttgattgtctc

SEQ ID NO: 465543 - DNA, 508 bp, Homo sapiens
  misc_feature: HEFZJCU01EPNK1.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctgggccagggaaccctggtcaccgtctcctcagcctccaccaacggcccatcggtcttcccctcggcaccctcctccaagagcacctctggggcacagcggcctgggctgcctgtcaaggactacttcgtactacg

SEQ ID NO: 465544 - DNA, 534 bp, Homo sapiens
  misc_feature: HEFZJCU01DI8T8.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagattcactgtatctacaactgaacagcctgagagtcgcagacacggccgtgtattactgtgcgagatgtaggaaaagtaatggctgtgtttattggggccaggggagccctggtcaccg

SEQ ID NO: 465545 - DNA, 356 bp, Homo sapiens; identical to SEQ ID NO: 444460
  misc_feature: HEFZJCU01DSHFZ.47.38.D05.1.454.heavy.3.raw

SEQ ID NO: 465546 - DNA, 513 bp, Homo sapiens
  misc_feature: HEFZJCU01B8XHB.13.71.G05.1.454.heavy.3.raw
tcacgtactacacgaccggtgctcgatttagtgtcgtcgcaagagagaggagccttagccctggactccaaggcctttccacttggtgatcagcactgagcacagaggactcaccatggaattggggctgagctgggttttccttgttgctattttagaaggtgtccagtgtgaggtgcagctggtggagtctggggggggcttggtccagcctggggggtccctgagactctcctgtgcagcctctggattcactttttagtaggtattggatgggttgggtccgccagactccagagaagggactggagtgggtggccaacataaaggaagatggaagtgaaagatactatgtggactctgtgaagggccgattcaccatctccagagacaacgccaagaactcactgtatctgcagatgaccagcctgagagtcgaggatacggctgtgtattattgtgcgagagatggggcacgacattttgtagaggtgtactgggggccaggggacg

SEQ ID NO: 465547 - DNA, 492 bp, Homo sapiens
  misc_feature: HEFZJCU01C1MJ5.51.38.D05.1.454.heavy.3.raw
cgatcgtatacacgaccggtgctcgatttagtatctgatagtgggtttgggctcaactctcttgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggctcttttttactgtgcgccaggaagcagtggctggccacatcatgcttttgatatctggagccaagggacaatggtcatcgtctcttcggcctccaccaagggcccatcggtcttccccctggcaccctcctccaagagcacctcg

SEQ ID NO: 465548 - DNA, 395 bp, Homo sapiens; identical to SEQ ID NO: 444517
  misc_feature: HEFZJCU01DH9EG.16.68.G02.1.454.heavy.3.raw

SEQ ID NO: 465549 - DNA, 396 bp, Homo sapiens; identical to SEQ ID NO: 444469
  misc_feature: HEFZJCU01ENJOH.47.46.E02.1.454.heavy.3.raw

SEQ ID NO: 465550 - DNA, 421 bp, Homo sapiens
  misc_feature: HEFZJCU01CDII9.7.1.A01.1.454.heavy.3.raw
cgtgtctctacacgaccggtgctcgatttagacgtctcatcaagggaaggaaggggctggagtgggtctcatccattagtagtagtagtagtttcatatactatgcagactcagtgaagggccgattcaccatctccagagacaacgccaagaactcactgtttctgcaaatgaacagcctgagagccgaggacacggctgtgtattactgtgcgagaccgcggatcagtgatactagtgtttattactaccgacgggattactacgctatggacgtctggggccaggggaccacggtcaccgtctcctcagcctccaccaagggcccatcggtcttccccctggcgccctgctccaggagcacctccgagagcacagcggccctgggctgcctggtcaaggactacttcctagagacacg

SEQ ID NO: 465551 - DNA, 396 bp, Homo sapiens; identical to SEQ ID NO: 444433
  misc_feature: HEFZJCU01CPD7I.47.59.F04.1.454.heavy.3.raw

SEQ ID NO: 465552 - DNA, 519 bp, Homo sapiens; identical to SEQ ID NO: 444867
  misc_feature: HEFZJCU01B1DP0.9.34.D01.1.454.heavy.3.raw

SEQ ID NO: 465553 - DNA, 503 bp, Homo sapiens; identical to SEQ ID NO: 455891
  misc_feature: HEFZJCU01EIWS6.48.37.D04.1.454.heavy.3.raw

SEQ ID NO: 465554 - DNA, 386 bp, Homo sapiens
  misc_feature: HEFZJCU01AIMBN.18.60.F05.1.454.heavy.3.raw
tacgagtatgcacgaccggtgctcgatttagtacgtcatcagggaaaggggctggaatatattgggattacctcttacagtgggaccacccattacaacccgtccctcaaaagtcgactcaccatttccgtggacacgtcgaaaacgagttctccctggacttgacctctgtgaccgccgcagacacggctgtttattactgtgcgagacgactacctgactccaatccatactttgactattgggccggggagccctggtcaccgtctcctcagcctccaccaagggcccatcggtcttccccctcggcgccctgctccaggagcacctcccgagagcacagcggccctgggctgcctggtcaaggactacttcccatactcgta

SEQ ID NO: 465555 - DNA, 516 bp, Homo sapiens
  misc_feature: HEFZJCU01EBX4B.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatatactgttcacgctctatggtcggggagttattagtccctactttgactactgggccagggaactctggtcaccgtcctccgcagcctccaccaacgggcccatcc

SEQ ID NO: 465556 - DNA, 520 bp, Homo sapiens; identical to SEQ ID NO: 453029
  misc_feature: HEFZJCU01BAQRI.16.86.H09.1.454.heavy.3.raw

SEQ ID NO: 465557 - DNA, 464 bp, Homo sapiens
  misc_feature: HEFZJCU01CAP33.5.86.H09.1.454.heavy.3.raw
atcagacacgcacgaccggtgctcgatttagtgctatagacttgggtttgggtccctgagactctcctgtgcagcctctggattcacctttactgattttggcatgacgtgggtccgccaggctccagggaaggggctggactggctctcaaatattaatggtaaaggcaatatacaagactacacagactccgtgaagggccggttcaccacctcgagagacaactccagggacacggtgtacctacacatgaacagcctgagagccgaggacacggccgtatattattgtgtgaggggaaactgggggcaatttgaccgctggggccagggaaccctggtcaccgtctcctcagcctccaccaagggcccatcggtcttccccctggcgccctgctccaggagcacctccgagagcacagcggccctgggctgcctggtcaggactacttcccgtgtctgat

SEQ ID NO: 465558 - DNA, 518 bp, Homo sapiens; identical to SEQ ID NO: 444718
  misc_feature: HEFZJCU01C74GG.9.34.D01.1.454.heavy.3.raw

SEQ ID NO: 465559 - DNA, 476 bp, Homo sapiens
  misc_feature: HEFZJCU01BTVCI.26.78.H01.1.454.heavy.3.raw
agactatactcacgaccggtgctcgatttagtgtgagtagtttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagttactatactatgcactgggtccgccaggctccaggcaaggggctggagtgggtggcagttatatcatatgatggaagcagcacatatacacagactccgtgaagggccgattcaccatctccagagacaatttgaagaacacgctgtatctgcaatgaacagcctgagagctgaagacacggctgtgttttactgtgcgagagaga

SEQ ID NO: 465560 - DNA, 532 bp, Homo sapiens
  misc_feature: HEFZJCU01CHK0Y.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaacgggcccatcggtccttccccctggtccgccctcg

SEQ ID NO: 465561 - DNA, 488 bp, Homo sapiens
  misc_feature: HEFZJCU01C0HZR.51.38.D05.1.454.heavy.3.raw
cgatcgtatacacgaccggtgctcgatttagtatctgatagttgggtttgggcatcactgaacacagaggactcaccatggagtttgggctgagcgtggtttccgtcgttaggctctttaagaggtgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggctcttttttactgttgcgccaggaagcagtggctggccacatcatgctttttgatatctggagccaagggacaatggtc

SEQ ID NO: 465562 - DNA, 501 bp, Homo sapiens
  misc_feature: HEFZJCU01ASX9G.26.23.C01.1.454.heavy.3.raw
agactatactcacgaccggtgctcgatttagtacacgtgattagggattgggaggcgtggtccagcctgggggctccctgagactctcctgtacaacgtctggattcaacttcaattattatgttctacactgggtccgccaggctccaggcaaggggctggagtgggtggcaggtatgtcacatgatggattcagtagatactacatagactccgtgaagggccgatcgaccatctccagagacgtttccgagaacacattaaatctggaaataaacttcgtgagaagtgacgactcggccgtttatttttgtgcgagagaggggtacagtagcggccgagctccggcctttgaccactgggccagggaaccctggtcaccgtctcctcagcctccaccaagggcccatcggtcttccccctggcgccctgctccaggagcacctccgagagcacagcggccctgggctgcctggtcaaggactacttccagtatagtct

SEQ ID NO: 465563 - DNA, 386 bp, Homo sapiens; identical to SEQ ID NO: 456194
  misc_feature: HEFZJCU01EZT42.18.60.F05.1.454.heavy.3.raw

SEQ ID NO: 465564 - DNA, 494 bp, Homo sapiens
  misc_feature: HEFZJCU01EQ1LI.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatgggaggtcgatattgta

SEQ ID NO: 465565 - DNA, 483 bp, Homo sapiens; identical to SEQ ID NO: 444932
  misc_feature: HEFZJCU01D3JMC.7.10.A10.1.454.heavy.3.raw

SEQ ID NO: 465566 - DNA, 507 bp, Homo sapiens
  misc_feature: HEFZJCU01C9CY4.12.11.A11.1.454.heavy.3.raw
  modified_base (443)..(443): a, c, t, g, unknown or other
atacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagagtctcctgtacaacctctggattcatgtttagtagtcattggatgaactgggtccgccaggctccagggaaggggctggagtgggtggccaacataaagcaagatggaagtgagaaatactatgtggactctgtgaagggccgattcacaatctccagagacaacgccaagaactcactgtatctgcaaataacagcctgaaanccgaggacacggctgtgtatttctgtgcgaggacgtcctacggtgacaatttattcaaccagac

SEQ ID NO: 465567 - DNA, 516 bp, Homo sapiens
  misc_feature: HEFZJCU01BE4QD.48.34.D01.1.454.heavy.3.raw
agtatacatacacgaccggtgctcgatttagatcgtctgtgttgggtttggggatttagatgtctgtgttgggtttggggggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctcgctccaggagcacctccgagagcacagcggccctgggctgcctggtcaggactacttcctatgtata

SEQ ID NO: 465568 - DNA, 521 bp, Homo sapiens
  misc_feature: HEFZJCU01CYVSG.10.83.H06.1.454.heavy.3.raw
catagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagttggtggagtctgggggaggcttggttcagccagggcggtccctgagactctcttgtacagcctctggatttaggtttcgtgattatgctatgagctggttccggcaggctccagggaaggggctggagtgggtaggtttcattagaagcatagcctatggtggggcttcagaatccgccgcgtctgtgaaaggccgattcaccatctcaagagacgatcccaaaagccctcgcctacctggaaatggacagcctgaaaagcgacgacacaggcgtctattattgtgttaggagggaccatcgcgatagcagttcctaggaggggg

SEQ ID NO: 465569 - DNA, 506 bp, Homo sapiens; identical to SEQ ID NO: 444732
  misc_feature: HEFZJCU01DOU04.14.78.H01.1.454.heavy.3.raw

SEQ ID NO: 465570 - DNA, 517 bp, Homo sapiens
  misc_feature: HEFZJCU01DTIIX.3.23.C01.1.454.heavy.3.raw
agacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaatgaacagcctggaagacgcggacacagccatgtattattgtacattaggacactatagtccctggggccagggaaccctcgtcaccgtctcctcagcctccaccaacgggcccagtcggtccttccccctcggtccgccccg

SEQ ID NO: 465571 - DNA, 520 bp, Homo sapiens
  misc_feature: HEFZJCU01BHLOS.10.9.A09.1.454.heavy.3.raw
catagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgctctttaagaggtgtccagtgtcaagtgcaactggtggagtctgggggaggcgtagtccagcctgggaggtcacagagactctcctgtgcagcctctgggttcaccttcagtagctacggcatgcacgtgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaagggagggggaacgagcgggagtccaagtactcctttgacgtcgtggggccg

SEQ ID NO: 465572 - DNA, 539 bp, Homo sapiens
  misc_feature: HEFZJCU01C7AZM.52.73.G07.1.454.heavy.3.raw
cgcagtacgacacgaccggtgctcgatttagctctacgctcagggggtgctttccgagagtcatggacctcctgcacaagaacatgaaacacctgtggttcttcctcctcctggtggcagctcccagatgggtcctgtcccaggtgcacctacaacagtggggcgcaggactgttgaagccttcggagaccctgtccctcacctgcgctgtcgatggtgggtccttcagtggtcgctactggacctggatccgccagcccccagggaaggggctggagtggattggggaatcaatcatactggaagcattaactataacccgtcccttaagagtcgagtcaccatatcagtcgacacgtccaagaaccaattctccctgaaggtgaggtctgttaccgccgcggacacggctgtctattactgtgcgaaaggccctcacgatgaaaactacgcccctggcgctatggacgtcgtggggccaagggaccacggtcaccgtctcctcagcctccaccaagggcccatcggtcttccccctc

SEQ ID NO: 465573 - DNA, 525 bp, Homo sapiens
  misc_feature: HEFZJCU01A9N4I.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccactaggtttgactacgtggggccagggaagcttggtccaccgtctcctcagcctacc

SEQ ID NO: 465574 - DNA, 541 bp, Homo sapiens
  misc_feature: HEFZJCU01CFKYT.53.68.G02.1.454.heavy.3.raw
cgcgtatacacacgaccggtgctcgatttagtcgatagtgaagggaaaggggcacaagaacatgaaacacctgtggttcttcctcctcctggtggcagctcccagatgggtcctgtcccaggtgcagctgcagcagtggggctcaggactgttgaagccttcggagaccctgtccctcacgtgcgctgtctatggtgggtcattcagtgattattattggacctggatccgccaggccccagggaaggggctggagtggatagcggaaatcaatcatagtggaaagactacctacaacccgtccctcaagagtcgagtcaccttatcggtagacacgcccaagaagcagttctccctgagggtgacgtctgtgaccgccgcggacacggctgtctattactgtgcgagaggccccttagtttcggtttttggactggttctcccatggaatccctactttgagtactggggccgcggagccctggtcaccgtctcctcagcctccaccaagggcccatccggtcttccccctggccaccct

SEQ ID NO: 465575 - DNA, 499 bp, Homo sapiens
  misc_feature: HEFZJCU01DKISO.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaaggggccgattcaccgtctccagagacaattccaggcacacgctgtatctgcaaatgaacagcctgagagctgaggacacggctgtgtattactgtgcgaaagatttctatagaggtgactacgggggcgttcg

SEQ ID NO: 465576 - DNA, 532 bp, Homo sapiens; identical to SEQ ID NO: 455739
  misc_feature: HEFZJCU01DAD3K.17.28.C06.1.454.heavy.3.raw

SEQ ID NO: 465577 - DNA, 533 bp, Homo sapiens
  misc_feature: HEFZJCU01AWFX6.53.78.H01.1.454.heavy.3.raw
cgcgtatacacacgaccggtgctcgatttagtgtgagtagtttgggtttgggctcaactcccaggtccagttggtgcagtctggggctgagttgaagaagcctgggtcctcggtgaaggtctcctgcaagtattctggaggcaccttcaacaactatggtatcagctgggtgcgacaggcccctggacaagggcttgagtggatgggaagggtcacccctatttttgatgaagcagactctgcacagaagttccagggcagattaacgattacggcggacaagtccacgactaccgcctacatggagctgaccagtctgaaatctgaggacacggccctttatactgtgcgagatataccgtgggggttacggcggagatatcgccatactacttcgactactggggccagggaaccctgatcaccgtctcctcagcctccaccaagggcccatcggtcttcccctggcaccctcctccaagacgcacctctgggggcacagcggccctgggctgcctggtcaaggactactt

SEQ ID NO: 465578 - DNA, 529 bp, Homo sapiens
  misc_feature: HEFZJCU01C34H2.19.48.E04.1.454.heavy.3.raw
tactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagcctggggggtccctgagactctcctgtacaggctctgggttctcctttagtagttattggatgaactgggcccgccaggctccggggaaggggccggagtgggtggccaacataatgcaagatggaactgagaaaaactatggggactctgtgaagggccgattcaccatctccagagacaaccgtaagaacttactgtttctgcaaatgaacagcctgagagccgaggacacggctgtgtattattgtgcgaagggcaggtgctgggacatggacgtctggggccagggaccaggtcaccgt

SEQ ID NO: 465579 - DNA, 531 bp, Homo sapiens
  misc_feature: HEFZJCU01BMEBB.12.12.B01.1.454.heavy.3.raw
atacgacgtacacgaccggtgctcgatttagtagtgtagattccgcgggggctttctgagagtcatggacctcctgtgcaggaacatgaagcacctgtggtttttcctcctgctggtggcagctcccagatggggcctgtcccaggtgcagctgcaggagtcgggcccaggactggtgaagccttcggagaccctgtccctcacctgcgctgtgtccggtttctccatcagtagtgggcattattggggctggatccggcagcccccagggaaggggctggagtgggattgggagtatctattttagcgggagcacctaccagaacgcgtccctcaagagtcgaatcaccatgtcggtggacacatcgaagaaccagatctcccttaagttgaggtctgtgaccgccgctgacacggccgtctattactgtgcgagagtccgtgctggaagaacacttttttgactattggggccagggaatctggtcaccgtcgcctcagcctccaccaaggcccatcggtcttcccccg

SEQ ID NO: 465580 - DNA, 517 bp, Homo sapiens
  misc_feature: HEFZJCU01ARIR4.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaagggctggagtgggtctcagttatttacaattctggtaccacatactactccgaccccgtgaagggccgattaaccatctccagagacgattccgagaacacggtgtatcttcaaatgaacaacctgagagcgacgacacggccgtttattactgtgcgagagattcgagtggttcggggacctcaccctggttctacttcgatctctc

SEQ ID NO: 465581 - DNA, 494 bp, Homo sapiens
  misc_feature: HEFZJCU01AKQN0.22.86.H09.1.454.heavy.3.raw
acatacgcgtcacgaccggtgctcgatttagtgctatagacttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacggg

SEQ ID NO: 465582 - DNA, 506 bp, Homo sapiens; identical to SEQ ID NO: 449318
  misc_feature: HEFZJCU01E0CZI.16.38.D05.1.454.heavy.3.raw

SEQ ID NO: 465583 - DNA, 506 bp, Homo sapiens
  misc_feature: HEFZJCU01C4088.47.48.E04.1.454.heavy.3.raw
agctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctggggaggcttggtccagcctggggggtccctcagactctcctgtgcagcctctggattcacctttagttcctcttggatgaattgggtccgccagactccagggaaggggctggagtgggttggcgaacagtaaatccagatggaagtcagaaaacctatgtggactctctgaagggcgattcaccatctccagagacaacgccaagaactctctgtttctgcaaatggacagcctgagagtcgaagacacggctgtgtattactgtgtgtctctgcgcctcggccggaccttggcttcg

SEQ ID NO: 465584 - DNA, 486 bp, Homo sapiens
  misc_feature: HEFZJCU01DIM1P.51.76.G10.1.454.heavy.3.raw
  modified_base (439)..(439): a, c, t, g, unknown or other
cgatcgtatacacgaccggtgctcgatttagtcactcatacagggggagcccagcactagaagtcggcggtgtttccattcggtgatcagcactgaacacagaggactcaccatggagtttgggctgagcgtgggttttcctcgttgctcttttaagaggtgtccagtgtcaggtgcagctggtggagtctgggggaggcgtggtccagcccgggaggtccctgagactctcctgtgcagcctctggattcaccttcagtgcctatggcatgcactgggtccgccaggctccaggcaaggggctggagtgggtggcatttatatcagatgatggcagtaataaagagtatgcagtctccgtgaaggccgattcaccatctccagagacaattcccagaacacactgtatctgcaaatgaacagattgagagctgagacncggctgtgtatttctgttgcgaaacgctatgagtgggagttaggggt

SEQ ID NO: 465585 - DNA, 526 bp, Homo sapiens
  misc_feature: HEFZJCU01CS3BL.13.38.D05.1.454.heavy.3.raw
tcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtctgggggggcttggttaagcctggggggtccctcagactctcctgtgcaacctctggattcattttctctgacgcctggttgagctgggtccgccaggctcccgggaagggctggagtgggttggccgtattaaaggtagaagacatggtcggacaacagactacagtgttcccgtgaaaggcagattcactatctcaagagatgactcaaaagaaatgatatatctgcaaatgaacaacctagaaaagcgaggacacaggcgtgtattactgtaccacagatgggccagatgcaaatggccgcgacgagttcgactactc

SEQ ID NO: 465586 - DNA, 523 bp, Homo sapiens
  misc_feature: HEFZJCU01CNJ0J.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatacctatgggggcttgttctggggccaggggaccctggtcatcgtctccccagcctccaccaagggcccatccggtcttcccctggcg

SEQ ID NO: 465587 - DNA, 492 bp, Homo sapiens
  misc_feature: HEFZJCU01BVZFR.11.71.G05.1.454.heavy.3.raw
  modified_base (485)..(485): a, c, t, g, unknown or other
cgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagntttctat

SEQ ID NO: 465588 - DNA, 509 bp, Homo sapiens
  misc_feature: HEFZJCU01DBFFU.48.44.D11.1.454.heavy.3.raw
agtatacatacacgaccggtgctcgatttagcgcagtacgaagggaggcttggtccagcctggggggtccctgaaactctcctgtacagcctctgggttcgccttcacagcctctgggttcagcttcagtgcctctgctatgcactgggtccgccaggcttccgggagaggggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtaacttctgaggtgacgggaaccgctggctattggggccagggaaccctggtcgccgtctcctcagcctccaccaagggcccatcggtcttcccctggcgccctgctcccaggagcacctccgagacgcacagcgccctgggctgcctggtcaaggactacttcctatgtatact

SEQ ID NO: 465589 - DNA, 512 bp, Homo sapiens
  misc_feature: HEFZJCU01CE43K.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtgcgttttctaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattaactgtgcgaaagcaccggcagttagtcacccatactactttgactactggggccg

SEQ ID NO: 465590 - DNA, 516 bp, Homo sapiens; identical to SEQ ID NO: 462174
  misc_feature: HEFZJCU01DM3BY.9.34.D01.1.454.heavy.3.raw

SEQ ID NO: 465591 - DNA, 516 bp, Homo sapiens
  misc_feature: HEFZJCU01D1TDE.48.57.F02.1.454.heavy.3.raw
agtatacatacacgaccggtgctcgatttagctcgatatagttgggtttggggggaaaaggaagactgacggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactacttcctatgtat

SEQ ID NO: 465592 - DNA, 533 bp, Homo sapiens
  misc_feature: HEFZJCU01EJU68.18.59.F04.1.454.heavy.3.raw
tacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcaacgctgtatctgcaaatgaacagcctgagaaccgaggacacagccgtgtattactgtaccacatcccctgaagcgtcaactactactactacggtatggacctcgg

SEQ ID NO: 465593 - DNA, 509 bp, Homo sapiens
  misc_feature: HEFZJCU01ADJT2.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatcctgacgacacggccgtctattactgtgcgagagtcccacgatccggtgagcctacggcaggcggccttttggacctttctc

SEQ ID NO: 465594 - DNA, 518 bp, Homo sapiens
  misc_feature: HEFZJCU01ALPW2.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggcccttgactacatgggatggatcaacaccggacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccaagagcacctctgggggcacagcgccctggctgcctggtcaaggactacttctagagacacg

SEQ ID NO: 465595 - DNA, 507 bp, Homo sapiens
  misc_feature: HEFZJCU01DHDFK.4.67.G01.1.454.heavy.3.raw
agcactgtagcacgaccggtgctcgatttagagtatacatattgggtttggggtctgagagaggagcccagccctgggattttcaggtgttttcatttggtgatcagggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgcgaaagatctcggctggtccgcggtccgggt

SEQ ID NO: 465596 - DNA, 379 bp, Homo sapiens; identical to SEQ ID NO: 444450
  misc_feature: HEFZJCU01EFBMB.47.77.G11.1.454.heavy.3.raw

SEQ ID NO: 465597 - DNA, 523 bp, Homo sapiens
  misc_feature: HEFZJCU01EJOWH.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctaactggccaatactatgggggcttgttctggggccaggggaccctggtcatcgtctccccagcctccaccaagggcccatcggtcttcccctggccg

SEQ ID NO: 465598 - DNA, 416 bp, Homo sapiens; identical to SEQ ID NO: 454455
  misc_feature: HEFZJCU01A18Z1.40.81.H04.1.454.heavy.3.raw

SEQ ID NO: 465599 - DNA, 538 bp, Homo sapiens
  misc_feature: HEFZJCU01AH02Q.17.28.C06.1.454.heavy.3.raw
  modified_base (486)..(486): a, c, t, g, unknown or other
  modified_base (524)..(524): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgnggaaaaagtatggctgtgtttattggggccaggggacncccgtggctacccg

SEQ ID NO: 465600 - DNA, 508 bp, Homo sapiens
  misc_feature: HEFZJCU01DL8NW.4.58.F03.1.454.heavy.3.raw
  modified_base (460)..(460): a, c, t, g, unknown or other
agcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaaagccttgagtggatgggatcgatcaactctggcaatggcaacacaaaatattcacagaagttacagggcagagtcaccattaccagggacacatccgcgaacacagcctacatggagctgagcagcctgacatctgaagacacggctgtgtattactgttcgagacgggntagtcgtgggatctagttatagtgacttcgtcgtttcgtggggtaccg

SEQ ID NO: 465601 - DNA, 513 bp, Homo sapiens
  misc_feature: HEFZJCU01BBD86.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattaactgtgcgaaagcaaccggcagttagtcacccatactactttgactactggggaccg

SEQ ID NO: 465602 - DNA, 526 bp, Homo sapiens; identical to SEQ ID NO: 453733
  misc_feature: HEFZJCU01AXT0A.9.78.H01.1.454.heavy.3.raw

SEQ ID NO: 465603 - DNA, 514 bp, Homo sapiens
  misc_feature: HEFZJCU01D64VQ.4.58.F03.1.454.heavy.3.raw
  modified_base (462)..(462): a, c, t, g, unknown or other
agcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaaagccttgagtggatgggatcgatcaactctggcaatggcaacacaaaatattcacagaagttacagggcagagtcaccattaccagggacacatccgcgaacacagcctacatggagctgagcagcctgacatctgaagacacggctgtgtattacttgttcgagacggggntacgtcgttggggatctaagttagtagttggactcgtcgtttctgggggccg

SEQ ID NO: 465604 - DNA, 534 bp, Homo sapiens
  misc_feature: HEFZJCU01DMLL6.13.64.F09.1.454.heavy.3.raw
tcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccattaaaaccagcagttatcactgggggtggatccggcagcccccggggaaggagctggagtggatggggaggatttattatactggcaatacttacgacaatccgtccctcaagagtcgagtcaccctgtccgtggacacgccgaataaccagttctccctgaaagtgacctctgtgaccgtcgcagacacggccatttattattgtgttgagatacgacttttggaattggctatgactcgatcgactactggggccctggaatcctggtcaccgtctcctcagcctccaccaaggcccatcgtcttcccctggcaccct

SEQ ID NO: 465605 - DNA, 528 bp, Homo sapiens
  misc_feature: HEFZJCU01DCNVW.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgtagagcgtcgtctgtcagtggaattgactactgggccagggaaccctggtcaccgtctcctcagcctccaccaa

SEQ ID NO: 465606 - DNA, 507 bp, Homo sapiens
  misc_feature: HEFZJCU01CTLVX.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccaggggaaccctggtcaccgtctcctcagcctccaccaagggcccatcggtcttcccctggcgcctgttccaggagcacctccgagagcacagcggccctgggctgcctggtcaggactacttccgagtgcgtct

SEQ ID NO: 465607 - DNA, 485 bp, Homo sapiens
  misc_feature: HEFZJCU01EEFX6.16.12.B01.1.454.heavy.3.raw
tgtactactccacgaccggtgctcgatttagtagtgtagatttgggcttggaacagcctggggggtccctgagactctcctgtgcaacctctggattcacctttaccagctatgccatgagctgggtccgccaggctccagggaaggggctggagtgggtcgcagccattagtggtattcgtgatgccacatactacgcagactccgtgaggggccggttcaccatctccagcgacacttccaggagcacgttgtatctgcaaatgaacagcctgagagtcgaggacacggccctatattactgtgcgaaagataagatttgggacccgatgcttatgatagctggggccaagggacaatggtcaccgtctcttcagcctccaccaagggcccatcggtcttcccctggcaccctcctccaagagcacctctgggggcacagcggccctgggctgcctggtcaaggactacttccgagtagtaca

SEQ ID NO: 465608 - DNA, 505 bp, Homo sapiens
  misc_feature: HEFZJCU01A02TZ.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatgggcactacatattattctgactccgtgaaggggccggttcaccctctccagagacacttccaacaacatcttgtatcttcacatgcacaatctgagagtcgacgacacggccacctatattgtgcgcgacatgactacgctcaattctggggccagggcg

SEQ ID NO: 465609 - DNA, 500 bp, Homo sapiens
  misc_feature: HEFZJCU01C0AI8.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccaggggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctgggccagggagcccaggtcaccgtctccccagcctccaccaaggcccatcggtcttcccctggcgccctgctccaggacgcacctccgagagcacagcggccctgggctgcctggtcaaggactactccacta

SEQ ID NO: 465610 - DNA, 503 bp, Homo sapiens; identical to SEQ ID NO: 445995
  misc_feature: HEFZJCU01ECZ1M.17.25.C03.1.454.heavy.3.raw

SEQ ID NO: 465611 - DNA, 487 bp, Homo sapiens
  misc_feature: HEFZJCU01DYO8G.12.75.G09.1.454.heavy.3.raw
atacgacgtacacgaccggtgctcgatttagtatagacatcagggggcatcacataacaaccacattcctcctctaaagaagcccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggagagtcatccctctctttcgttcagcagactacgtacagaaattccaggacagagtcacgattaccgcggacgaatccacgaccacagcctacatagagctgcgcagcctgagatctgaagacacggccattttattactgtgcgagagatgcagggccctccacatcggttattttc

SEQ ID NO: 465612 - DNA, 519 bp, Homo sapiens
  misc_feature: HEFZJCU01C23HG.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccagttgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaaactcctactacggtctggacgtctggggccaggggaccaac

SEQ ID NO: 465613 - DNA, 482 bp, Homo sapiens
  misc_feature: HEFZJCU01B8V2K.49.8.A08.1.454.heavy.3.raw
agtcgagagacacgaccggtgctcgatttagcatactctacaggggtctgggagaggagcccagcactagaagtcggcggtgtttccattcggtgatcagcactgaacacagaggactcaccatggagtttgggctgagctgggttttcctcgttgctcttttaagtaggtgtccagtgtcaggtgcagctggtggagtctgggggagggcgtggtccagcctgggaggtccctgagactctcctgtgcagcctctggattcaccttcagggtctatgacatgcactgggtccgccaggctccaggcaaggggctggagtgggtggcagttatatcatatgatggaagcaatatatactatgtagactccgtgagggccgattcatcatctcccagagacagttccgagaacacgctgtatctgcaaatagaacagcctgagagctgagacacggctgtgtattactgtgcgacttaatcac

SEQ ID NO: 465614 - DNA, 507 bp, Homo sapiens
  misc_feature: HEFZJCU01E1RAD.8.38.D05.1.454.heavy.3.raw
  modified_base (485)..(485): a, c, t, g, unknown or other
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaagaggggggagtanagtggcagctccaagtacttac

SEQ ID NO: 465615 - DNA, 502 bp, Homo sapiens
  misc_feature: HEFZJCU01A23FK.3.63.F08.1.454.heavy.3.raw
agacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagtttgttgggcgggataggcaggcggtacc

SEQ ID NO: 465616 - DNA, 477 bp, Homo sapiens; identical to SEQ ID NO: 453049
  misc_feature: HEFZJCU01EUUZN.40.37.D04.1.454.heavy.3.raw

SEQ ID NO: 465617 - DNA, 501 bp, Homo sapiens; identical to SEQ ID NO: 447123
  misc_feature: HEFZJCU01DZCG7.3.20.B09.1.454.heavy.3.raw

SEQ ID NO: 465618 - DNA, 529 bp, Homo sapiens
  misc_feature: HEFZJCU01A38XA.13.38.D05.1.454.heavy.3.raw
tcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtctggggggggcttggttaagcctggggggtccctcagactctcctgtgcaacctctggattcattttctctgacgcctggttgagctgggtccgccaggctcccgggaaggggctggagtgggttggccgtattaaaggtagaagacatggtcggacaacagactacagtgttcccgtgaaaggcagattcactatctcaagagatgactcaaaagaaatgatatatctgcaaatgaacaacctgaaaagcgaggacacaggcgtgtattactgtaccacagatgggccagatgacaaatggccgcgacgagttcgactacgtc

SEQ ID NO: 465619 - DNA, 513 bp, Homo sapiens
  misc_feature: HEFZJCU01B6O4U.52.25.C03.1.454.heavy.3.raw
cgcagtacgacacgaccggtgctcgatttagtagtgtagatttgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggataccccataaccggctactacttacactgggtgcgacaggcccctggacaagggcttgagtggatggggtggaacaatcccaacagtggaggcaccggtcgcacagaatatgcgcggaagtttcagggcagggtcaccatgaccagcgacaggtccactaacacagcctacatggagctaagtagactgacatctgacgacacggccgtctattattgtgtgagagaggacccgatgacctcgaacatggacgtctggggcca

SEQ ID NO: 465620 - DNA, 532 bp, Homo sapiens
  misc_feature: HEFZJCU01ETE2Q.16.86.H09.1.454.heavy.3.raw
  modified_base (502)..(502): a, c, t, g, unknown or other
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagacgacccctccgatagcagtggctggtccacgttaggtttgactacgtggggccaggggaancgttggtcaccggtctcctcacgcctaccc

SEQ ID NO: 465621 - DNA, 403 bp, Homo sapiens; identical to SEQ ID NO: 445456
  misc_feature: HEFZJCU01D150T.3.72.G06.1.454.heavy.3.raw

SEQ ID NO: 465622 - DNA, 528 bp, Homo sapiens
  misc_feature: HEFZJCU01DFMRR.7.70.G04.1.454.heavy.3.raw
  modified_base (417)..(417): a, c, t, g, unknown or other
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaaggcctggagtggattggatacatctattactttgggagcacctactacaacccgtccctcaagagtcgagtaacgatctcagtggacacgtctaacaatcacctctcctgaggctgagctctgtgacagccgnggacacgggcgtttattactgtgcgagagggacgactacggtgactacgtgggggttcgaccccgtggggcccagggaaccctgggtacaccgtctcctcagcctccaccg

SEQ ID NO: 465623 - DNA, 506 bp, Homo sapiens
  misc_feature: HEFZJCU01A2UGG.16.38.D05.1.454.heavy.3.raw
tgtactactccacgaccggtgctcgatttagtatctgatagttgggtttgggctgggagacgagcccagcactggaagtcgccggtgtttccattcggtgatcagcactgaatacagaggactcaccatggagtttgggctgagctgggttttcctcgttactcttttaagaggtgtccaatgtcaggtgcagttggtggagtctgggggaggcgtggtccagcctggaaggtccctgagactctcgtgtgcagcgtctggattcatctttaatagttttcctatgcactggatccgccaggctccaggcaggggactggagtgggtggcaggagtgtcacttgatggagccaatacatacttcgcagactccgtgaagggccgattcaccatttccagagagaattccaacaacacgctgcatctgcaaatggacaccctgagacctgacgacaacggctgtctattactgtgtgagactcttattgcgttcggctttgactacg

SEQ ID NO: 465624 - DNA, 460 bp, Homo sapiens
  misc_feature: HEFZJCU01BG45J.13.6.A06.1.454.heavy.3.raw
tcacgtactacacgaccggtgctcgatttagatctactgacagggcttctggaggctccttcaccacttatgctatcagctgggtgcgacaggcccctggacaagggcttgagtggatgggagggatcacccctctgtctaatacagcagactacgcacagaagttccagggcagagtcacaattaccgcggacgcatccacgagcacagcttacatggagctgagaagcctgagatctgaggacacggccgtgtttactgtgcgagacgaggttgtaccagtactaactgctacaccacaaatcactactttgactcctggggccagggaaccctggtcaccgtctcctcagcctccaccaagggcccatcggtcttcccctggcgccctgctccaggagcacctccgagagcacagcggcctgggctgcctggtcaaggactacttccgtactagacg

SEQ ID NO: 465625 - DNA, 490 bp, Homo sapiens
  misc_feature: HEFZJCU01D1RA1.19.53.E09.1.454.heavy.3.raw
tactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctggggggaggcttggtacagcctggcaggtccctgagactctcctgtgcagcctctggattcacctttgatgattatgccatgcactgggtccggcaagctccagggaaggcctggagtgggtctcaggtattagttggaatagtgctagtatagcctatgcggactctgtgaagggccgattcaccatctccagagacaacgccaagaactccctgtatctgcaaatgaacagtctagagagctggaggacacggccttgtattactgtgcaaggaggt

SEQ ID NO: 465626 - DNA, 524 bp, Homo sapiens
  misc_feature: HEFZJCU01DJHW9.48.34.D01.1.454.heavy.3.raw
  modified_base (519)..(519): a, c, t, g, unknown or other
agtatacatacacgaccggtgctcgatttagatcgtctgtgttgggtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaacgtggggccagggaaccctggtcaccgtctcctcagcctccaccaagggcccatcgtcttcccctcggcgccctgcctccaggngcacc

SEQ ID NO: 465627 - DNA, 513 bp, Homo sapiens; identical to SEQ ID NO: 446452
  misc_feature: HEFZJCU01B2CEH.17.33.C11.1.454.heavy.3.raw

SEQ ID NO: 465628 - DNA, 475 bp, Homo sapiens
  misc_feature: HEFZJCU01B12AR.52.15.B04.1.454.heavy.3.raw
cgcagtacgacacgaccggtgctcgatttagacagtatatatccgcggggtctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctgggggaggcgtggtccagcctgggaggtccctgagactctcctgtgcaggctctgcatttcccttcaataactatgctatcgattgggtccgccaggctccaggcaagggactggagtgggtggcagtaatatcagctgatggaggcactaaatattacgctgattctgcgaggggccgattcaccatatccagagacaactcccaagatgtgatatatctacaaatgaacagcctgagacctgaggacacggctgtatattattgtgcgt

SEQ ID NO: 465629 - DNA, 531 bp, Homo sapiens
  misc_feature: HEFZJCU01CYV3Q.22.36.D03.1.454.heavy.3.raw
acatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacagccgggggggtccctgacactctcctgtgcagcctctggattcacagtcagcagcaatgccatgagttgggtccgccaggctccaggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacgacggccgtcgtaccttctgttgcgaaaggaccctactaactttttggggtccgccgggccgacctaccgtgggggccgac

SEQ ID NO: 465630 - DNA, 502 bp, Homo sapiens
  misc_feature: HEFZJCU01EQHSN.47.3.A03.1.454.heavy.3.raw
agctcacgtacacgaccggtgctcgatttagagagcgtcacagagtagaaggggctcagagaggagccttagccccggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccagggaaggggctggagtgggttggcaacataaatccagatggaagtcagaaaacctatgtggactctctgaagggccgattcaccatctccagagacaacgccaagaactctctgtttctgcaaatggacagcctgagagtcgaagacacggctgtgtattactgtgtgtctctgacgcctggccgtacgtcgt

SEQ ID NO: 465631 - DNA, 496 bp, Homo sapiens; identical to SEQ ID NO: 444697
  misc_feature: HEFZJCU01CF1F0.16.37.D04.1.454.heavy.3.raw

SEQ ID NO: 465632 - DNA, 530 bp, Homo sapiens
  misc_feature: HEFZJCU01AV2AV.47.6.A06.1.454.heavy.3.raw
agctcacgtacacgaccggtgctcgatttagatctactgacagcacacaagggggggaaatactttctgagagtcctggacctcctgtgcaagaacatgaaacatctgtggttcttccttctcctggtggcagctcccacatgggtcctgtcccaggtgcagctgcaggagtcgggcccaggactggtgaagccttcggagaccctgtccctcacttgcactgtctctggtggctccatcaggagttactactggacctggcttcggcagtccccagggaagggactggagtggattgggtataattattacagtgggaccaccaactacaacccctccctcaagagtcgagtcaccatatcaatagacacgtcgaagaaccagttctccctgaagttgaactcagtgaccgctgcggacacggccgtgtattactgtgcgagaccacaccgattaccgatttttggagtggtccttgtataactggggtccaggggatcctggtcaccgtctcctcagcctccaccaac

SEQ ID NO: 465633 - DNA, 514 bp, Homo sapiens
  misc_feature: HEFZJCU01CP4R2.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaggagggggaacagcggagtccaagtactcctttgacgtctggggccgtac

SEQ ID NO: 465634 - DNA, 493 bp, Homo sapiens
  misc_feature: HEFZJCU01DIJNI.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgacagcctgagagccgaggacacgggtgtttatactgtggagaaatcctagtggca

SEQ ID NO: 465635 - DNA, 500 bp, Homo sapiens
  misc_feature: HEFZJCU01B649M.53.28.C06.1.454.heavy.3.raw
cgcgtatacacacgaccggtgctcgatttagagctcacgtattgggtttgggagacgagcccagcactggaagtcgccggtgtttccattcggtgatcatcactgaacacagaggactcaccatggagtttgggctgagctgggttttcctcgttgctcttttaagaggtgtccagtgtcaggttcagctggtgcagtctgggggaggcgtagtccagcctgggaggtccctgagactctcctgtgtagcctctggattcacccccagaaactctgccatgcactgggtccggcaggctccaggcaaggggctggagtgggtgtccagtatatcgtatgatggtgacagtgaatactacgcagcctccgtgaggggccgattcaccgtctccagagacaattccaagaacacggtgtatctgcaaatgaagggcctgagacctgaggacacggcaacatactactgtgcgaatgacgtggatgtcgtggctacgccttta

SEQ ID NO: 465636 - DNA, 503 bp, Homo sapiens; identical to SEQ ID NO: 457193
  misc_feature: HEFZJCU01B4H8O.17.25.C03.1.454.heavy.3.raw

SEQ ID NO: 465637 - DNA, 501 bp, Homo sapiens
  misc_feature: HEFZJCU01CNT0C.48.73.G07.1.454.heavy.3.raw
agtatacatacacgaccggtgctcgatttagctctacgctcagggggctttctgagagtcatggatctcatgtgcaagaaaatgaagcacccgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtgggccaagggacaatggtcaccgtctcttc

SEQ ID NO: 465638 - DNA, 516 bp, Homo sapiens
  misc_feature: HEFZJCU01ENH4Y.48.53.E09.1.454.heavy.3.raw
agtatacatacacgaccggtgctcgatttagagagagtgtgttgggtttggggatttagatgtctgtgttgggtttggggggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactacttcctatgtata

SEQ ID NO: 465639 - DNA, 508 bp, Homo sapiens
  misc_feature: HEFZJCU01D4TZP.48.81.H04.1.454.heavy.3.raw
agtatacatacacgaccggtgctcgatttagtagtgtagattcgcggggcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccattttacctactgtgcgcggggagtggacggagctcggtttcggagttatcatctactactttgtaa

SEQ ID NO: 465640 - DNA, 510 bp, Homo sapiens
  misc_feature: HEFZJCU01A35F2.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacgggctatctattactgtgcgaaactctcattccgttcatctgaatactggggcagggaaccctggtcgccg

SEQ ID NO: 465641 - DNA, 415 bp, Homo sapiens; identical to SEQ ID NO: 444794
  misc_feature: HEFZJCU01DELWM.14.74.G08.1.454.heavy.3.raw

SEQ ID NO: 465642 - DNA, 510 bp, Homo sapiens
  misc_feature: HEFZJCU01DUTZM.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggcccatatattactgtgacgaaagcaccggcagttagtcacccatactactttgactacgtgggg

SEQ ID NO: 465643 - DNA, 379 bp, Homo sapiens; identical to SEQ ID NO: 444450
  misc_feature: HEFZJCU01AQQ7U.47.77.G11.1.454.heavy.3.raw

SEQ ID NO: 465644 - DNA, 506 bp, Homo sapiens
  misc_feature: HEFZJCU01CGO15.51.69.G03.1.454.heavy.3.raw
cgatcgtatacacgaccggtgctcgatttagtcgctgcgtaaaggagaaaggggctgggagaggagccccagccctgagattcccaggtgtttccattcagtgatcagcactgaacacagaggactcaccatggagttgggactgagctggattttccttttggctattttaaaaggtgtccagtgtgaagtgcagctggtggaatctgggggaggcttggtacagcctggcaggtccctgagactctcctgtgcggtctctggattcacctttgatgattatgccatgcactgggtccggcaagctccagggaagggcctggagtgggtctcaggtattaactgggatggtggaagcattgggtatgcggactctgtgaggggccgattcaccatctccagagacaacgccaagaactccctgtatctgcaaatggacagtctgagagctgaggacacggccttgtattattgtgttaaagataccagcaactatacggggccct

SEQ ID NO: 465645 - DNA, 513 bp, Homo sapiens
  misc_feature: HEFZJCU01CZJ63.13.39.D06.1.454.heavy.3.raw
  modified_base (486)..(486): a, c, t, g, unknown or other
tcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactggagtggattgggcttatcaatgccagtgggggcaccagctacaacccctccctccaagagccgcgtcacccatttcagtagacacgtccaagaaccagctctccctgaagctgagttctgtgaccgccgcagacacggccgtgtattactgtgcgcgacaggtggacgtctggggccaagggaccacggtacaccgtcncctcagcctccaccaacgggcccatcc

SEQ ID NO: 465646 - DNA, 520 bp, Homo sapiens; identical to SEQ ID NO: 462797
  misc_feature: HEFZJCU01CDW3J.19.86.H09.1.454.heavy.3.raw

SEQ ID NO: 465647 - DNA, 495 bp, Homo sapiens
  misc_feature: HEFZJCU01A3NKB.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaagggctggaatgggtctcatctattagtgctactactggtggcacatacttcgcagactccgtgaagggccggttctccatctccagagacaattccaagaacacgctgtatctgcaattgaacagcctgagagccgaggacacggccgtatattactgtgcgaaagattttaggggaatggaaccactc

SEQ ID NO: 465648 - DNA, 390 bp, Homo sapiens; identical to SEQ ID NO: 444541
  misc_feature: HEFZJCU01E0Y70.16.24.C02.1.454.heavy.3.raw

SEQ ID NO: 465649 - DNA, 396 bp, Homo sapiens; identical to SEQ ID NO: 452518
  misc_feature: HEFZJCU01B5066.47.42.D09.1.454.heavy.3.raw

SEQ ID NO: 465650 - DNA, 484 bp, Homo sapiens
  misc_feature: HEFZJCU01EF2X1.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagaggcccccataacg

SEQ ID NO: 465651 - DNA, 515 bp, Homo sapiens
  misc_feature: HEFZJCU01EENO3.52.78.H01.1.454.heavy.3.raw
cgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctgggccgtggcaccctggtcactgtcttctcagcctccaccaaggcccatcggtcttcccctggcaccctcctccaagagcacctctgggggcacagcggccctgggctgcctgtcaaggactacttcctatacga

SEQ ID NO: 465652 - DNA, 493 bp, Homo sapiens
  misc_feature: HEFZJCU01CE1IL.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacgacggtctatctgcacctgaccagcctgagaactgacgacacgtctctctactactgtgcgagagagttgacgaggt

SEQ ID NO: 465653 - DNA, 503 bp, Homo sapiens
  misc_feature: HEFZJCU01BVKHZ.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgtttctgcaaatgaacagcctgagaattgaggactcggggtatattactaactgtgcccgtgacccctgactgataaaccggactggttcgacccgtggggccagggaaccctggtcaccgtctcctc

SEQ ID NO: 465654 - DNA, 520 bp, Homo sapiens
  misc_feature: HEFZJCU01ERGSJ.17.34.D01.1.454.heavy.3.raw
  modified_base (508)..(508): a, c, t, g, unknown or other
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaattaacgaacacagtaatctggagctgacagcctgtcatctgaggacacgggcttctacttctgtgcgaggagtaattactataacactgctcttttactacctccttgacttctgggcntggacccgtccg

SEQ ID NO: 465655 - DNA, 521 bp, Homo sapiens; identical to SEQ ID NO: 445317
  misc_feature: HEFZJCU01DN9N1.12.40.D07.1.454.heavy.3.raw

SEQ ID NO: 465656 - DNA, 515 bp, Homo sapiens; identical to SEQ ID NO: 451390
  misc_feature: HEFZJCU01D7B5N.16.2.A02.1.454.heavy.3.raw

SEQ ID NO: 465657 - DNA, 323 bp, Homo sapiens; identical to SEQ ID NO: 448089
  misc_feature: HEFZJCU01EX511.18.17.B06.1.454.heavy.3.raw

SEQ ID NO: 465658 - DNA, 515 bp, Homo sapiens
  misc_feature: HEFZJCU01EADWN.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtcccccaacacagggactgcagtggattggatacatctacttcagtgggaaccccaactacaacccctccctcaggattccagtcgccatatccctggactcgtccaacaaccagatctccctgacgatgacatctgtgaccgctgcggacacagccgtttattactgtgcgcgatctgggcgactcagtgactatggtatggacgtctgggggccaagggaccacggtcatcgtctcctcagcctccaccaagggcccatccggtcttccccctggcc

SEQ ID NO: 465659 - DNA, 510 bp, Homo sapiens
  misc_feature: HEFZJCU01EQ90S.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagaccgctactggggcccgggagccctggtc

SEQ ID NO: 465660 - DNA, 533 bp, Homo sapiens
  misc_feature: HEFZJCU01B4X2V.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacattttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttggggccagggaaccctggtcaccgtctcctcagcctccaccaagggcccatcggtcttcccctggccaccctcctccagagcacctctgggggcacagcggccctgggctgcctc

SEQ ID NO: 465661 - DNA, 484 bp, Homo sapiens; identical to SEQ ID NO: 448457
  misc_feature: HEFZJCU01CJUW9.11.23.C01.1.454.heavy.3.raw

SEQ ID NO: 465662 - DNA, 522 bp, Homo sapiens
  misc_feature: HEFZJCU01AKEW2.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtcgggggcccacgaaccgtttactacgctatggacgtcgtgggggaccg

SEQ ID NO: 465663 - DNA, 487 bp, Homo sapiens; identical to SEQ ID NO: 445219
  misc_feature: HEFZJCU01BK70D.10.85.H08.1.454.heavy.3.raw

SEQ ID NO: 465664 - DNA, 387 bp, Homo sapiens; identical to SEQ ID NO: 454519
  misc_feature: HEFZJCU01D7PE5.16.77.G11.1.454.heavy.3.raw

SEQ ID NO: 465665 - DNA, 512 bp, Homo sapiens
  misc_feature: HEFZJCU01B74TT.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgtttctgcaaatgaacagcctgagaattgaggactcgggtatatactactgtgcccgtgaccccctcgactgataaaccggactggttcgtacccgtcgggtccgacgggaaccgtacggtcgaccgtcctcctccg

SEQ ID NO: 465666 - DNA, 426 bp, Homo sapiens; identical to SEQ ID NO: 456107
  misc_feature: HEFZJCU01B9R1T.9.34.D01.1.454.heavy.3.raw

SEQ ID NO: 465667 - DNA, 524 bp, Homo sapiens
  misc_feature: HEFZJCU01CAGIQ.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagccctccaccaagggcccatccggtcttccccctgccg

SEQ ID NO: 465668 - DNA, 522 bp, Homo sapiens; identical to SEQ ID NO: 447798
  misc_feature: HEFZJCU01DKJ7K.12.40.D07.1.454.heavy.3.raw

SEQ ID NO: 465669 - DNA, 530 bp, Homo sapiens
  misc_feature: HEFZJCU01EG9JL.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacatccctgaaagcgtcaactactactactacggtatggacctctggg

SEQ ID NO: 465670 - DNA, 506 bp, Homo sapiens
  misc_feature: HEFZJCU01DHOY1.53.33.C11.1.454.heavy.3.raw
cgcgtatacacacgaccggtgctcgatttagagtgagctcgttgggtttgggggaggcgtggcccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgacccctggggccagggaaccctggtcaccgtctcctcagcttccaccaagggcccatcggtcttccccctggcgccctgctccaggagcacctctgggggcacagcggccctgggctgcctggtcaaggactactcctcgtact

SEQ ID NO: 465671 - DNA, 503 bp, Homo sapiens
  misc_feature: HEFZJCU01DZ7P0.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccgattcaccatctccagagacgattccaagaacacgttgtatcttcaatgaacagcctgacagtcgacgacacggccatgtatttttgtgcgagcgaccggggctcctcaatggctttcatt

SEQ ID NO: 465672 - DNA, 533 bp, Homo sapiens; identical to SEQ ID NO: 452208
  misc_feature: HEFZJCU01C7FF0.11.10.A10.1.454.heavy.3.raw

SEQ ID NO: 465673 - DNA, 537 bp, Homo sapiens
  misc_feature: HEFZJCU01DK0RV.48.38.D05.1.454.heavy.3.raw
agtatacatacacgaccggtgctcgatttagtatctgatagttgggtttgggtgggtttgggggaggtgtgtcacaagatttgggctccttcggctggtctggggtgacctctctccgcttcacctggagcattctcaggggctgtcgtgatgattgcgtggtgggactctgtcccgctccaaggcacccgctctctgggacgggtgccccccggggtttttggactcctgggggtgacttagcagccgtctgcttgcagttggacttcccaggccgacagtggtctggcttctgaggggtcaggccagaatgtggggtacgtgggaggccagcagagggttccatgagaagggcaggacagggccatggacagtcagcttccatgtgacgcccggagacagaaggtctctgggtggctgggtttttgtggggtgaggatggacattctgccattgtgattactactactactacggtatggacgtctggggccaagggaccacggtcaccgtctcctcagcttccaccaagggccc

SEQ ID NO: 465674 - DNA, 505 bp, Homo sapiens
  misc_feature: HEFZJCU01A86QI.26.80.H03.1.454.heavy.3.raw
agactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctgggctgaagtgaagaagcctggggcctcagtgaaggtctcctgcaaggcttctggatacaccttcaccgcctactatatccactgggtgcggcaggcccctggacaagggcttgagtggatgggacacatcagccctaacactggtgacacaaactatgcacagagatttcagggcagggtcaccatgaccacggacacgtccataagcacagtttacatggaggtaaataggctgagatctgacgacacggccgtatattactgtgcgttattaacggacgatttacgattgttttgatttggtttttacg

SEQ ID NO: 465675 - DNA, 482 bp, Homo sapiens
  misc_feature: HEFZJCU01D5949.43.14.B03.1.454.heavy.3.raw
tgtgagtagtcacgaccggtgctcgatttagtgtgagtagttccgcgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtatcactgtgcgagagggaggggggtatagcacg

SEQ ID NO: 465676 - DNA, 512 bp, Homo sapiens
  misc_feature: HEFZJCU01EAN46.15.23.C01.1.454.heavy.3.raw
tctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctggtccagccgggggggtccctgagactctcctgtgccgcctctggactcacctttagtagctattggatgagctgggtccgccaggctccagggaaggggctggagtgggtggccaacataaaggaagatggaagtcagaaacactatgtggactctgtgaagggccgattcaccatctccagagacaacgccaagaattcagtgtatctgcaaatgaacagcctgagagccgaggacacggccgtgtattactgtgtgagagacatgacaacggtgataaccggagggttg

SEQ ID NO: 465677 - DNA, 502 bp, Homo sapiens
  misc_feature: HEFZJCU01CI6EQ.48.4.A04.1.454.heavy.3.raw
agtatacatacacgaccggtgctcgatttagagtagtgatcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgtatgcctttgatatgtggggccaagggacaatggtcaccgtcgtt

SEQ ID NO: 465678 - DNA, 532 bp, Homo sapiens; identical to SEQ ID NO: 445228
  misc_feature: HEFZJCU01DKUU9.7.78.H01.1.454.heavy.3.raw

SEQ ID NO: 465679 - DNA, 525 bp, Homo sapiens
  misc_feature: HEFZJCU01BEW0Z.43.57.F02.1.454.heavy.3.raw
tgtgagtagtcacgaccggtgctcgatttagctcgatatagttgggtttgggggaggcttgatacagccgggggggtccctgagactctcctgtgtagcctctggattcacctttaacaactatgccatgacctgggtccgccaggctccagggaaggggctggagtgggtctcagtaataagtggaagtgctggtaccacactttatgcagactccgtgatgggccggttcaccatctccagagacaattccaagaacacgctgtgtctgcaaatgaacagcctgagagccgaagacacggccgtatattactgtgcgagaggcgtcggagagtacgatattttgactggttatttgcgctactactactacgctttggacgtctggggccaagggaccacggtcaccgtctcctcagcctccaccaagggcccatcggtcttccccctggcgccctgctccaggagcacctccgagagcacagcggccctgggctgcctggtcaaggactacttccactactc

SEQ ID NO: 465680 - DNA, 507 bp, Homo sapiens
  misc_feature: HEFZJCU01AHT5M.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgactccggtgagcctacggcagcggtcctttggacttcgtc

SEQ ID NO: 465681 - DNA, 423 bp, Homo sapiens; identical to SEQ ID NO: 446550
  misc_feature: HEFZJCU01ED9OW.11.22.B11.1.454.heavy.3.raw

SEQ ID NO: 465682 - DNA, 492 bp, Homo sapiens
  misc_feature: HEFZJCU01BZWNQ.4.28.C06.1.454.heavy.3.raw
agcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgtggacgccgtgaggggccgattcaccatcttcagagacaacgccaaggacacgctgtatctggaaatgagcagtctgagagccgaggacacggctgtgtattactgtgcaagagataacggacttggtacgccctttgactactggggcccggggaccctggtcaccgtctcctcggcctccaccaagggcccatcggtcttcccctggcgccctgctccaggagcacctccgagagcacagcggccctgggctgcctggtcaaggactacttccctacagtgct

SEQ ID NO: 465683 - DNA, 517 bp, Homo sapiens
  misc_feature: HEFZJCU01EHRZ8.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaaggacacctccacaaaccaggtggtccttacaatgaccaatatggaccctgtgggacacagccacatattactgttcacgctctatggttcggggagttattagtccctactttgacttactggggccagggaactcgtggtcaccgtctccgcagcctccaccaagggccc

SEQ ID NO: 465684 - DNA, 525 bp, Homo sapiens; identical to SEQ ID NO: 448120
  misc_feature: HEFZJCU01CK9DT.22.85.H08.1.454.heavy.3.raw

SEQ ID NO: 465685 - DNA, 504 bp, Homo sapiens
  misc_feature: HEFZJCU01DCHWW.11.19.B08.1.454.heavy.3.raw
cgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtctgggggaagcttggtacagcctggagggtccctgagactcttctgtgcagcctctggattcgactttagtagttatgaaatgaactgggtccgccaggctccagggaaggggctggagtgggtttcatacatttctagtaattctggtaccatacactatgcagtctctgtgaagggccgattcaccatctccagagacaacgccaggaactcactttatctgcaaatgagcagcctgagagtcgaggacacgggtatttattactgtgcgagagatagtctgtctatgcttccgggagctaacta

SEQ ID NO: 465686 - DNA, 498 bp, Homo sapiens; identical to SEQ ID NO: 449824
  misc_feature: HEFZJCU01EZZVV.47.38.D05.1.454.heavy.3.raw

SEQ ID NO: 465687 - DNA, 504 bp, Homo sapiens; identical to SEQ ID NO: 445353
  misc_feature: HEFZJCU01B1NKK.10.38.D05.1.454.heavy.3.raw

SEQ ID NO: 465688 - DNA, 438 bp, Homo sapiens
  misc_feature: HEFZJCU01DJMRV.3.21.B10.1.454.heavy.3.raw
agacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgtttattactgtgcaagagcgaggaggagcagttttgacagctggggccaggggaaccctggtcaccgtctcctcagcctccaccaagggcccatcggtcttccccctggcgccctgctccaggagcacctccgagagcacagcggccctgggctgcctggtcaaggactacttccgagtgcgtct

SEQ ID NO: 465689 - DNA, 519 bp, Homo sapiens
  misc_feature: HEFZJCU01CPRNO.53.10.A10.1.454.heavy.3.raw
cgcgtatacacacgaccggtgctcgatttagcgtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgccctccaggggggacctttggggtttcgaccctggggccagggaaccctggtcaccgtctcctcagcctccaccaagggctcatcggtcttccccctggcaccctcctccaagagcacctctgggggc

SEQ ID NO: 465690 - DNA, 510 bp, Homo sapiens
  misc_feature: HEFZJCU01B03PL.15.1.A01.1.454.heavy.3.raw
tctacgtagccacgaccggtgctcgatttagacgtctcatcagggtcttcgtggctcacgtccaccaccacgcatgtgacctcaggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgtgaagggcagattcaccatctccagagacaatttggagaacaccgtgattcttaatatgaacagcctgagagccgatgacacggctgtgtatttctgtgcgagagacgggtataatagttactggtttggccactggggccagggaaccctggtcatcgtctcgtcagcctccaccaagggcccatcggtcttccccctggcaccctcctccaagagcacctctgggggcacagcggccctgggctgcctggtcaaggactacttccgctacgt

SEQ ID NO: 465691 - DNA, 416 bp, Homo sapiens; identical to SEQ ID NO: 454455
  misc_feature: HEFZJCU01BEU2O.40.81.H04.1.454.heavy.3.raw

SEQ ID NO: 465692 - DNA, 482 bp, Homo sapiens; identical to SEQ ID NO: 445068
  misc_feature: HEFZJCU01D1MHX.11.23.C01.1.454.heavy.3.raw

SEQ ID NO: 465693 - DNA, 510 bp, Homo sapiens
  misc_feature: HEFZJCU01EDU93.40.35.D02.1.454.heavy.3.raw
tctagcgactcacgaccggtgctcgatttagcacacgatagttgggtttgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaagggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgacggccccgagcgcagtggtcttttgatgcctttgattatggtgggccgaagggacaagtggtaccaccgtt

SEQ ID NO: 465694 - DNA, 538 bp, Homo sapiens
  misc_feature: HEFZJCU01BYSG6.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaagtaatggctgtgtttattgggggccaggggagccctggtcctaccg

SEQ ID NO: 465695 - DNA, 499 bp, Homo sapiens
  misc_feature: HEFZJCU01BBSIV.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaattgataggctctatgactggacttctc

SEQ ID NO: 465696 - DNA, 405 bp, Homo sapiens
  misc_feature: HEFZJCU01DMTQN.3.17.B06.1.454.heavy.3.raw
agacgcactccacgaccggtgctcgatttagtcgatagtgaaggggctggagtgggttggccgttctagagacacaactaacagtgacaccgcacaatacgccgcgtctgtgaaaggcagattcaccatctcaagagatgattcagagaactcactttatctgcaaatgaacagccagagaaccgacgacacggccgtctattattgtgtcatagacctaggatacaacgacggtggtacctggtattcgcggtgggtctactggggccagggaaccctggtcaccgtctcctcagcctccaccaagggcccatcggtcttccccctggcgccctgctccaggagcacctccgagagcacagcggccctgggctgcctggtcaaggactacttccgagtgcgtct

SEQ ID NO: 465697 - DNA, 514 bp, Homo sapiens
  misc_feature: HEFZJCU01C87GH.51.45.E01.1.454.heavy.3.raw
cgatcgtatacacgaccggtgctcgatttagtgagtcagtaagggaaagggggggagacgagcccagcactcgaagtcgccggtgtttccattcggtgatcatcactgaacacagaggactcaccatggagtttgggctgagctgggttttcctcgttgctcttttaagaggtgtccagtgtcaggtgcggctggtggagtctgggggaggcgtggtccagcctggggattccctgagaatctcctgtgcagcctctggattcaacttcaatagacatcctatgcactgggtccgccaggctccaggcaaggggctggaatgggtggcagttatttcgtccactggaaacagtaaacattatggacgctccgtgaagggcccattcgccatctccagagacaattccaaaataccctctatctgcgaatgaacagcctgcgacctgaagacacggctatatatttctgtgcgagaggggagtcttattgtaatgatggttcctgctatcgtttt

SEQ ID NO: 465698 - DNA, 535 bp, Homo sapiens
  misc_feature: HEFZJCU01C4NNZ.51.26.C04.1.454.heavy.3.raw
cgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtctggggccaagggaccacggtcaccgtctccttagcctccaccaagggcccatcggtcttcccctggccaccctcctccaagacgcaccctctc

SEQ ID NO: 465699 - DNA, 476 bp, Homo sapiens; identical to SEQ ID NO: 444605
  misc_feature: HEFZJCU01DXTZI.12.81.H04.1.454.heavy.3.raw

SEQ ID NO: 465700 - DNA, 499 bp, Homo sapiens
  misc_feature: HEFZJCU01CH7DG.4.19.B08.1.454.heavy.3.raw
agcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactctgggagaggcgtggtccagcctgggaggtccctgagactctcctgtatagcctctggattcaccttcggcagttatgctatgcactgggtccgccaggctccaggcaaggggttggagtgggtggcagcaatatcatatgatggaagtgataaatattacatagagtccgtgaagggtcgattcaccatctccagagacaatcgcaagaacacactgtatctggaaatgaccagcctgagaggtgacgacgacgggtgtttattactgtgcgcgggatagaggctcatcgtggatactaaac

SEQ ID NO: 465701 - DNA, 482 bp, Homo sapiens; identical to SEQ ID NO: 444503
  misc_feature: HEFZJCU01C1MH8.7.10.A10.1.454.heavy.3.raw

SEQ ID NO: 465702 - DNA, 502 bp, Homo sapiens
  misc_feature: HEFZJCU01AUOKS.17.74.G08.1.454.heavy.3.raw
cgtagactagcacgaccggtgctcgatttagtagctctatcagggtcttcgtggctcacgtccaccaccacgcatgtgacctcaggggtccctgagactctcctgtgcagcctctggattcaccttcagtacctactggatgcactgggtccgccaagctccagggaaggggctggagtggctctcacgtgttgataatgttggcagtttcacaaatacgcggactccgtgaagggccgattcaccatctccagagacaacgccaagaacacgctgtatctgcaaatgaacagtctgagagccgaggacacggctgtttattactgtgcaagacagcactacagtcactacttcgacccctggggccagggaaccctggtcaccgtctcctcagcctccaccaagggcccatcggtcttcccctggcaccctcctccaagagcacctctgggggcacagcggccctgggctgcctggtcaaggactacttccctagtctacg

SEQ ID NO: 465703 - DNA, 519 bp, Homo sapiens; identical to SEQ ID NO: 444867
  misc_feature: HEFZJCU01CGTJW.9.34.D01.1.454.heavy.3.raw

SEQ ID NO: 465704 - DNA, 487 bp, Homo sapiens
  misc_feature: HEFZJCU01BJ70V.47.85.H08.1.454.heavy.3.raw
agctcacgtacacgaccggtgctcgatttagtatcactcagtcggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctgggtcatcgtctcctcagcctccaccaagggcccatcggtcttcccctggcgccctgctccaggagcacctccgagagcacagcggccctgggctgcctgtcaaggactacttcctacgtgagct

SEQ ID NO: 465705 - DNA, 539 bp, Homo sapiens
  misc_feature: HEFZJCU01E0A3Z.14.57.F02.1.454.heavy.3.raw
  modified_base (385)..(385): a, c, t, g, unknown or other
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgngtgaaagatacgaagtctatgatacccaatttgggaggggccgtttcatgtctggggccaagggacgctggtcaccgtctcttcagcctccaccaagggcccatcggtcttccccctggcaccctcctccaagagcacctctgggggcacagcc

SEQ ID NO: 465706 - DNA, 435 bp, Homo sapiens
  misc_feature: HEFZJCU01EDCNL.48.12.B01.1.454.heavy.3.raw
agtatacatacacgaccggtgctcgatttagtagtgtagattccgcgggcacgaccggtgctcgatttagtgagtcagtaagggaaaggggctggagtgggtctcatccattagtagtagcagtaattatatagacgacgcagactcagtgaagggccgattcaccatctccagagacaacgccaagcactcactgtatctccaaatgaacagcctgagagccgacgacacggctgtgtattactgtgcgagacttgggagagagtgggacctactgttccactttgactactggggccagggaaccctggtcaccgtctcctcagcctccaccaagggcccatcggtcttccccctggcaccctcctccaagagcacctctgggggcacagcggccctgggctgcctggtcaaggactacttcctatgtatact

SEQ ID NO: 465707 - DNA, 524 bp, Homo sapiens
  misc_feature: HEFZJCU01C912H.48.4.A04.1.454.heavy.3.raw
agtatacatacacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttctccctgaactgaccgctgtgaccgccgcggacacggctgtgtattactgtgcgagacgaatgggcgggtggctacgacttgacttttggggccagggaaacctggtcaccgtctccccagcttccaccaaggcccatcggtcttcccccg

SEQ ID NO: 465708 - DNA, 522 bp, Homo sapiens
  misc_feature: HEFZJCU01A7HXJ.12.33.C11.1.454.heavy.3.raw
atacgacgtacacgaccggtgctcgatttagagtgagctcgttgggtttggggggaagaggaagactgacggtccccccaggagttcaggtgctgggcacggtgggcatgtgtgagttttgtcacaagatttgggctcaactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaaggcccatcggtcttcccctggcaccctcctccaagagcacctctgggggcacagcc

SEQ ID NO: 465709 - DNA, 523 bp, Homo sapiens
  misc_feature: HEFZJCU01DCTX9.16.27.C05.1.454.heavy.3.raw
tgtactactccacgaccggtgctcgatttagacgcgatcgaagggtttggggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttattcatatgatggaactactcaacactatccagactccggggagggccgattcaccgtctccagagacaattccaagaacagggtgtttctccaagtgattgatctgagaagtgaggacacggctgtttattactgtgcgcggtggctgaccgctcttgactactgggggccagggaccctggtcatcgt

SEQ ID NO: 465710 - DNA, 540 bp, Homo sapiens
  misc_feature: HEFZJCU01B3D4L.51.49.E05.1.454.heavy.3.raw
cgatcgtatacacgaccggtgctcgatttagagcgactagcaacacacaaagggggtggtttctgagagtcatggacctcctggacaagaacatgaaacccctgtggttcttcctcctcctggtggcagctcccagatgggtcctgtcccaggtgcaactgcagcagaggggcgcaagactgttgaagcctttggagaccctgtccctcacctgcactctttctggtgcgactttcagtggttatttctggggctgggtccgccagccccccgggaagggacttcagtggattggggaaatcagtcgtagtggagagaccttctacaacccgtccctcaagagtcgagtcgccatatcaacagacgcgtccaagagtgaggtgtccctgacactcaggtctgtgaccgccgcggacgcggctgtatactactgtgcgagacgtcccgctgggtttggagtggttattatgccggtatggacgtcgtggggcgcgaggaccgacggtcgccgtcgtcttcagcctccaccaaggccctacg

SEQ ID NO: 465711 - DNA, 509 bp, Homo sapiens; identical to SEQ ID NO: 445070
  misc_feature: HEFZJCU01EZG3D.12.14.B03.1.454.heavy.3.raw

SEQ ID NO: 465712 - DNA, 529 bp, Homo sapiens
  misc_feature: HEFZJCU01EMRSY.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctggggccggggaaccctggtcaccgtctccccaccctccaaccg

SEQ ID NO: 465713 - DNA, 501 bp, Homo sapiens; identical to SEQ ID NO: 447719
  misc_feature: HEFZJCU01DVABE.17.10.A10.1.454.heavy.3.raw

SEQ ID NO: 465714 - DNA, 493 bp, Homo sapiens
  misc_feature: HEFZJCU01C8YYO.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatgggagtcgatattgta

SEQ ID NO: 465715 - DNA, 396 bp, Homo sapiens; identical to SEQ ID NO: 444469
  misc_feature: HEFZJCU01B5MZ8.47.46.E02.1.454.heavy.3.raw

SEQ ID NO: 465716 - DNA, 516 bp, Homo sapiens
  misc_feature: HEFZJCU01EAJ0V.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaaccggcagttagtccacccatacttactttgactacgtggggacccg

SEQ ID NO: 465717 - DNA, 511 bp, Homo sapiens; identical to SEQ ID NO: 452200
  misc_feature: HEFZJCU01CAWU5.16.71.G05.1.454.heavy.3.raw

SEQ ID NO: 465718 - DNA, 509 bp, Homo sapiens
  misc_feature: HEFZJCU01D7P82.9.12.B01.1.454.heavy.3.raw
  modified_base (465)..(465): a, c, t, g, unknown or other
tgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagcctgggggtccctgaactctcctgtgcagcctctggatacaccgtcagtagtaactccatgaactgggtccgccaggctccagggaaggggctggagtgggtctcagttatttatagcggtggtaacacatactacgcagactccgtgaagggcagattcaccatctccagagacaattccagaacacgctgtatcttcaaatgaacagcctgagagtcgaggacacggctgtatattacngtgcgagagatgtgtacgtcttttgatatctggggcaagggtaa

SEQ ID NO: 465719 - DNA, 530 bp, Homo sapiens; identical to SEQ ID NO: 455130
  misc_feature: HEFZJCU01EHLDL.7.78.H01.1.454.heavy.3.raw

SEQ ID NO: 465720 - DNA, 519 bp, Homo sapiens; identical to SEQ ID NO: 450177
  misc_feature: HEFZJCU01B4H6D.9.34.D01.1.454.heavy.3.raw

SEQ ID NO: 465721 - DNA, 507 bp, Homo sapiens; identical to SEQ ID NO: 459976
  misc_feature: HEFZJCU01CPKKK.18.50.E06.1.454.heavy.3.raw

SEQ ID NO: 465722 - DNA, 326 bp, Homo sapiens
  misc_feature: HEFZJCU01AMUE4.40.20.B09.1.454.heavy.3.raw
tctagcgactcacgaccggtgctcgatttagtgtagtgtgaagggccgattcaccatctccagagacaacgccgggaactccctgtatctgcaaatgaagagcctgcgagccgaggacacgggtgtttattattgtactaaaggacaagagggactttgggagtactactacggtatggacgtctggggccaagggaccgccgtcaccgtctcctcagcttccaccaagggcccatcggtcttccccctggcgccctgctccaggagcacctctggggcacagcggccctgggctgcctggtcaaggactacttccagtcgctaga

SEQ ID NO: 465723 - DNA, 483 bp, Homo sapiens
  misc_feature: HEFZJCU01A45PY.10.35.D02.1.454.heavy.3.raw
  modified_base (456)..(456): a, c, t, g, unknown or other
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctggcgccctgctccaggagcacctccgagagcacagcggccctgggctgccnggtcaaggactacttcccactactatg

SEQ ID NO: 465724 - DNA, 530 bp, Homo sapiens
  misc_feature: HEFZJCU01E1BSX.53.64.F09.1.454.heavy.3.raw
cgcgtatacacacgaccggtgctcgatttagcgcgtatacaagggggagagaggagcccagccctgggattttcaggtgttttcatgtggtgatcaggactgaacagagagaactcaccatggagtctgggctgacgtggctttttcttgtggctattttaaaaggtgtccagtgcgacgtgcagctggtggagtcggggggaggcttggtacagccgggggggtccctgagactctcctgtagagtctctggcttcacctttggagtctatgacatgagttgggtccgccaggctccggggaagggctggagtgggtctcaacgatcagtgatagcggaagtaccacaaactacgccgcctccgtgaagggccgatgcaccgtctccagagacaattcgaaggacactttatatctgcaactcaacagactgacaaccgctgacacggcgtctattactgtgtcaaagaagaccggaccgctggacgaggagccagaggaaaatcactactttgactacgtggggccaa

SEQ ID NO: 465725 - DNA, 508 bp, Homo sapiens
  misc_feature: HEFZJCU01EDP77.48.35.D02.1.454.heavy.3.raw
agtatacatacacgaccggtgctcgatttagcacacgatagttgggtttggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagaagggttttacagtggttcggggagtctccgaccagcaactggttaccg

SEQ ID NO: 465726 - DNA, 515 bp, Homo sapiens
  misc_feature: HEFZJCU01BVPDB.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagcgtggcgttttcttaggtggctattttaaaaggtgtccagtgtgaggtgcagctgttggagtctgggggaggcttggcacagcctgggggtccctgagactctcctgtgcagcctctgaattcatcttcagtatctataacatgaactgggtccgccagactccagggaaggggctggagtgggtcgcatccattagtggtggtaataattacatatactacggagactcaatgaagggccgcttcaccatctccagagacaacgccgaaaactcactgtatctgcagatgaacagcctgagagccgaagacacggctgtgtattactgtgcgagaggtcttactatagttcggggagtttaatataacgacgttatttcgta

SEQ ID NO: 465727 - DNA, 518 bp, Homo sapiens; identical to SEQ ID NO: 459134
  misc_feature: HEFZJCU01B8T6S.9.43.D10.1.454.heavy.3.raw

SEQ ID NO: 465728 - DNA, 535 bp, Homo sapiens
  misc_feature: HEFZJCU01CY5L7.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtgccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaatggctgtgtttattggggccaggggagccctggtcaccg

SEQ ID NO: 465729 - DNA, 401 bp, Homo sapiens
  misc_feature: HEFZJCU01C51PR.3.72.G06.1.454.heavy.3.raw
agacgcactccacgaccggtgctcgatttagctacgactgcaagggaaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgagaggcaggctgtggggcatagtgggtactacctatgcttttgatatctggggccaagggacaatggtcaccgtctcttcagcctccaccaaggcccatcggtcttccccctggcaccctcctccaagagcacctctgggggcacagcggcctgggctgcctggtcaaggactacttccgagtgcgtct

SEQ ID NO: 465730 - DNA, 509 bp, Homo sapiens
  misc_feature: HEFZJCU01DHRJN.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcaccctccccaagagcacctctgggggcacagcggcccgtgggctgcctggtcaaggactacttcctacgtcgtat

SEQ ID NO: 465731 - DNA, 511 bp, Homo sapiens
  misc_feature: HEFZJCU01AMBA8.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagctttgatctctggggccaaggggacactggtcaccgtctcttcagcctccaccaacggcccatcggtcttcccccttggccgccctgcctccaggacg

SEQ ID NO: 465732 - DNA, 433 bp, Homo sapiens
  misc_feature: HEFZJCU01DBXV0.40.34.D01.1.454.heavy.3.raw
tctagcgactcacgaccggtgctcgatttagatcgtctgtgttgggtttgggatacaactttaccatctactggatcgcctgggtgcgccagatgcccgggaaaggcctagagtgggtgggaatcgtctatcctgacgactctgataccagatacagcccgtccttccaaggccaggtcaccatctcagccgacaagtccgtcaataccgcctacctgcagtggagcagtctgcaggcctcggacaccgccatgtacttctgtgcgagagggttcggggatgactactggggccagggaaccctggtcaccgtctcttcagcttccaccaagggcccatcggtcttccccctggcgccctgctccaggagcacctccgagacgcacagcggccctggggctgcctggtcaaggactacttccagtcgctagga

SEQ ID NO: 465733 - DNA, 504 bp, Homo sapiens
  misc_feature: HEFZJCU01C3HUP.3.85.H08.1.454.heavy.3.raw
agacgcactccacgaccggtgctcgatttagtatcactcagtcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctggtggagtctgggggaggcttggtacagcctggggggtccctgagactctcctgtgcagcctctggattcacctttagtaattatgccatgagctgggtccgccaggctccagggaaggggctggagtgggtctcagctattagtgatcgtggtggtaacacatactacgcagactccgtgaagggccgcttcaccatctccagagacaattccaagaacacgctgcatctgcaaatgaacagcctgagagccgaggacacggccctttatactgtgcgaaaccatcacgtataactggaactacgta

SEQ ID NO: 465734 - DNA, 383 bp, Homo sapiens; identical to SEQ ID NO: 446695
  misc_feature: HEFZJCU01C065C.22.85.H08.1.454.heavy.3.raw

SEQ ID NO: 465735 - DNA, 515 bp, Homo sapiens
  misc_feature: HEFZJCU01CFCK4.3.71.G05.1.454.heavy.3.raw
agacgcactccacgaccggtgctcgatttagtgtcgtcgcaagagagagggggagctctgggagaggagccccagccctgagattcccaggtgtttccattcagtgatcagcactgaacaccagaggactcaccatggagttgggactgagctggattttccttttggctattttaaaaggtgtccggtgtgaagtgcaactggtggagtccgggggaggcttggtacagcctggcaggtccctgagactctcctgtgcagcctctggattcacctttgatgattatgccatgcactgggtccggcaagctccagggaagggcctggagtgggtctcaggtattacttggaatagtgataacatcggctatgcggactctgtgaagggccgattcaccatctccagagacaacgccaagaactccctgtatctgcaaatgaacagtctgagacctgaggacacggccttgtattactgtgtaaagtcccggggaaatatgtacgtattttggtaa

SEQ ID NO: 465736 - DNA, 481 bp, Homo sapiens; identical to SEQ ID NO: 464885
  misc_feature: HEFZJCU01AVX8Y.22.36.D03.1.454.heavy.3.raw

SEQ ID NO: 465737 - DNA, 509 bp, Homo sapiens; identical to SEQ ID NO: 444586
  misc_feature: HEFZJCU01CNK0D.12.78.H01.1.454.heavy.3.raw

SEQ ID NO: 465738 - DNA, 507 bp, Homo sapiens
  misc_feature: HEFZJCU01BO9FW.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctcggcgccctgctccaggagcacctctggggcgac

SEQ ID NO: 465739 - DNA, 508 bp, Homo sapiens
  misc_feature: HEFZJCU01BZHYX.13.36.D03.1.454.heavy.3.raw
tcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaatggggcgcagggctgttgaagccttcggagaccctgtccctcacgtgcgctgtctctggtgggttcttcagtggttactactggagctggatccgccagtccccagggaaggggctggagtggattggggaaatcaatcatagtggaagcaccaactacaacccgtccctcgagagccgagtcaccatgtcagtagacacgtccaagaaccagttctccctgagggtgagctctgtgaccgccgcggacacggctgtgtacttctgtgcgagaggcaattttggactcgtcattctccctttgacttctggggcaggaccctagtcaccgt

SEQ ID NO: 465740 - DNA, 520 bp, Homo sapiens
  misc_feature: HEFZJCU01EPNK8.48.57.F02.1.454.heavy.3.raw
agtatacatacacgaccggtgctcgatttagctcgatatagttgggtttgggttttccttgttgctattttagaaggtgtccagtgtgaagtgcagctggtggagtctgggggaggcttggtccagcctggggggtccctaagactctcctgtgcagcctctggattcacctttagtacctattggatgacctgggtccgccaatctccaggggggggggctggagtgggtggccaatataaagggagatggaagtgtgacacactatgtggactctgtgaagggccgattcaccatctccagagacaatgccaaggagtcactgtatctgcagatgaacagcctgagagccgaggacgcggctgtgtattactgtgcgagagatgcgaatccctctcgatagtaatggtcgttattatgatgcttttgatatgtgggcaagggacaacggtcaccggtctcttcagcctccaccaagggcccatccggtcttccccctggccgccctgcctccaggacg

SEQ ID NO: 465741 - DNA, 519 bp, Homo sapiens
  misc_feature: HEFZJCU01EKAO5.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtcgtggggccaagggaccg

SEQ ID NO: 465742 - DNA, 520 bp, Homo sapiens
  misc_feature: HEFZJCU01DB4A6.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctgggccaaggtacagcggtcaccgtcgcctcagcctccaccaagggcccatcggtcttcccctggccaccctcctccaagagcacctctcgggggcacac

SEQ ID NO: 465743 - DNA, 542 bp, Homo sapiens
  misc_feature: HEFZJCU01A23QI.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggcttttcttgtggctttttaaaaggtgcccagtgtgaggtgcaactgttggagtctgggggaggcttggtacagccgggggggtccctgagactctcctgtgcagcctctggattcaatttaacagctttgccatgggctgggtccgccaggctccagggaaggggctggagtgggtctcgaatattaatgaaaggggtgataacacatactatgcggactctgtaaggggccggttcaccatctccagagacaattccaagaaacactgtatctgcaattaacagcctgagagtcgaggacacggccctttatactgtgcgaaggatcgcccctataatggtggctggatcgggggagtttgggttcctgggggtccaggggaaccctggtccg

SEQ ID NO: 465744 - DNA, 538 bp, Homo sapiens; identical to SEQ ID NO: 448861
  misc_feature: HEFZJCU01EC3F3.14.57.F02.1.454.heavy.3.raw

SEQ ID NO: 465745 - DNA, 520 bp, Homo sapiens; identical to SEQ ID NO: 446810
  misc_feature: HEFZJCU01B27SE.16.86.H09.1.454.heavy.3.raw

SEQ ID NO: 465746 - DNA, 520 bp, Homo sapiens
  misc_feature: HEFZJCU01DR02U.13.87.H10.1.454.heavy.3.raw
tcacgtactacacgaccggtgctcgatttagcagtactgcgttgggtttggggggggagaggacgccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgttattattgtgacaaaagatcccaaaccccttacgtattttggaagtggtttacg

SEQ ID NO: 465747 - DNA, 529 bp, Homo sapiens
  misc_feature: HEFZJCU01CLBQ7.17.28.C06.1.454.heavy.3.raw
  modified_base (522)..(522): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaatggctgtgtttattggggccagggngccctgg

SEQ ID NO: 465748 - DNA, 371 bp, Homo sapiens; identical to SEQ ID NO: 444435
  misc_feature: HEFZJCU01EVBPT.3.42.D09.1.454.heavy.3.raw

SEQ ID NO: 465749 - DNA, 517 bp, Homo sapiens; identical to SEQ ID NO: 446891
  misc_feature: HEFZJCU01EVR46.17.33.C11.1.454.heavy.3.raw

SEQ ID NO: 465750 - DNA, 515 bp, Homo sapiens
  misc_feature: HEFZJCU01EF1HK.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactgggccagggaaccctggtcaccgtctcctcagcctccaccaagggcccatcggtcttcccctggcacctcctcaagagcacctctgggggcacagcggccctgggctgcctggtcaaggactacttcctaggacacg

SEQ ID NO: 465751 - DNA, 492 bp, Homo sapiens
  misc_feature: HEFZJCU01DLE34.51.38.D05.1.454.heavy.3.raw
cgatcgtatacacgaccggtgctcgatttagtatctgatagttgggtttggggactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggctctttttactgtgcgccaggaagcagtggctggccacatcatgcttttga

SEQ ID NO: 465752 - DNA, 505 bp, Homo sapiens
  misc_feature: HEFZJCU01BNDJS.13.33.C11.1.454.heavy.3.raw
tcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaataagaattgcaaacgatgtcttttgatatgtggggccaagggactacg

SEQ ID NO: 465753 - DNA, 528 bp, Homo sapiens
  misc_feature: HEFZJCU01EGCAD.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactacgtggggccagggaaccctggtcaccgtctcctcagcctccacc

SEQ ID NO: 465754 - DNA, 483 bp, Homo sapiens; identical to SEQ ID NO: 444639
  misc_feature: HEFZJCU01D6YAG.11.23.C01.1.454.heavy.3.raw

SEQ ID NO: 465755 - DNA, 491 bp, Homo sapiens; identical to SEQ ID NO: 445333
  misc_feature: HEFZJCU01B3DU6.19.53.E09.1.454.heavy.3.raw

SEQ ID NO: 465756 - DNA, 522 bp, Homo sapiens
  misc_feature: HEFZJCU01BC7NZ.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcctttcaatttctattccatgcactgggtccgccaggctccaggcaaggggctcgagtgggtgacacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttccccctggcg

SEQ ID NO: 465757 - DNA, 521 bp, Homo sapiens
  misc_feature: HEFZJCU01A7BA6.12.40.D07.1.454.heavy.3.raw
atacgacgtacacgaccggtgctcgatttagtgatagagcgtaacaacagagggctcaccatggagtttgggctgagcgtggtttcgtcgttaggctctttaagaggtgtcagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttcccctggccg

SEQ ID NO: 465758 - DNA, 519 bp, Homo sapiens
  misc_feature: HEFZJCU01DXZMW.4.33.C11.1.454.heavy.3.raw
agcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatgaacagcctgaagaccgaggacacagccgtctattactgtgttagggtagttttacgtagtttttggagtggtatatttaa

SEQ ID NO: 465759 - DNA, 499 bp, Homo sapiens
  misc_feature: HEFZJCU01A2I3E.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagagagctattatctggaaccccgat

SEQ ID NO: 465760 - DNA, 500 bp, Homo sapiens; identical to SEQ ID NO: 445720
  misc_feature: HEFZJCU01ASU5C.3.20.B09.1.454.heavy.3.raw

SEQ ID NO: 465761 - DNA, 509 bp, Homo sapiens; identical to SEQ ID NO: 453913
  misc_feature: HEFZJCU01DTC8V.22.82.H05.1.454.heavy.3.raw

SEQ ID NO: 465762 - DNA, 378 bp, Homo sapiens; identical to SEQ ID NO: 444419
  misc_feature: HEFZJCU01D9BNE.47.77.G11.1.454.heavy.3.raw

SEQ ID NO: 465763 - DNA, 501 bp, Homo sapiens; identical to SEQ ID NO: 456866
  misc_feature: HEFZJCU01ASAYW.48.34.D01.1.454.heavy.3.raw

SEQ ID NO: 465764 - DNA, 515 bp, Homo sapiens; identical to SEQ ID NO: 445422
  misc_feature: HEFZJCU01D1517.4.57.F02.1.454.heavy.3.raw

SEQ ID NO: 465765 - DNA, 315 bp, Homo sapiens
  misc_feature: HEFZJCU01AVXAV.19.25.C03.1.454.heavy.3.raw
tactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggactacttcccacgagagta

SEQ ID NO: 465766 - DNA, 496 bp, Homo sapiens
  misc_feature: HEFZJCU01C1C1L.10.71.G05.1.454.heavy.3.raw
catagtagtgcacgaccggtgctcgatttagtgtcgtcgcaagagagaggggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacgacgggtgtttattactgtgggagaaatcctagtggcatcacctggt

SEQ ID NO: 465767 - DNA, 427 bp, Homo sapiens; identical to SEQ ID NO: 444708
  misc_feature: HEFZJCU01CTPA5.9.34.D01.1.454.heavy.3.raw

SEQ ID NO: 465768 - DNA, 523 bp, Homo sapiens
  misc_feature: HEFZJCU01DACFI.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggacggttttgggcgcggactcctcttgagatctggggccagggggacaatggtcaccgtctcttcagtcc

SEQ ID NO: 465769 - DNA, 395 bp, Homo sapiens; identical to SEQ ID NO: 444494
  misc_feature: HEFZJCU01B7YL7.47.46.E02.1.454.heavy.3.raw

SEQ ID NO: 465770 - DNA, 507 bp, Homo sapiens
  misc_feature: HEFZJCU01CD65Y.13.39.D06.1.454.heavy.3.raw
tcacgtactacacgaccggtgctcgatttagtgacatctcgcaggttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacaggaccctgtccctcatctgcagtgtctctggtggctccttcagcagtggtagtttctactggagctggatccggcagcccgccgggaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctggggccaagggaccacggtcaccgtctcctcagcctccaccaagggccc

SEQ ID NO: 465771 - DNA, 486 bp, Homo sapiens
  misc_feature: HEFZJCU01DQVLO.53.26.C04.1.454.heavy.3.raw
cgcgtatacacacgaccggtgctcgatttagtctagcgactttgggtttgggggagcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcagggcagggtctccatgaccagggacagggccatcagaacagcctacatggagctgaacagactgacatctgacgacacggccgtttattagttgtgtgagagaggacccga

SEQ ID NO: 465772 - DNA, 535 bp, Homo sapiens
  misc_feature: HEFZJCU01EAJB5.49.34.D01.1.454.heavy.3.raw
agtcgagagacacgaccggtgctcgatttagatcgtctgtgttgggttttcctcgttgctcttttaagaggtgtccagtgtcaggtgcagctggtggagtctggggggaggcgtggtccagcctgggaggtccctgagactctcctgtgtagtctctggattcaccttcagggtctatgacatgcactgggtccgccaggctccaggcaaggggctggagtgggtggcagttatatcaaatgatgcaagtaacaaatactatgtagactccgtgaagggccgattcaccatctccagagacaattccaagaatacgctgtatctgcacatgaacagcctgagagccgaagacacgggtgtttattactgtgcgaacttaattacggaggacaacggtaaccccgtccgcacggtacggacgtctggggccaagggaccgacggtcaccgtctcctcacgcctccaccaacgggcccatcggtccttcccctggccaccctcctccaagacgcacctctcggggcacagcggcctc

SEQ ID NO: 465773 - DNA, 493 bp, Homo sapiens; identical to SEQ ID NO: 446596
  misc_feature: HEFZJCU01EZXCL.19.1.A01.1.454.heavy.3.raw

SEQ ID NO: 465774 - DNA, 356 bp, Homo sapiens; identical to SEQ ID NO: 444460
  misc_feature: HEFZJCU01ACLDY.47.38.D05.1.454.heavy.3.raw

SEQ ID NO: 465775 - DNA, 526 bp, Homo sapiens
  misc_feature: HEFZJCU01CN2UJ.13.25.C03.1.454.heavy.3.raw
tcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacagtccggggctgaggtgaagaagcctgaggcctcagtgaaggtctcctgcaaggcttccggatacaccctcaatggaaactatgtccactatgtgcgacaggccccaggacaagggcttctgtggatggggtggatcaaccctaatagtggtgacacaaaactatgagaagaaatttgagggccgggtcaccatgaccagggacacgtccatcaatacagccttcatggaactgaccagactgacctctgacgacacggccgtgtattactgtgcggtcgaaactcagcctaacttacttgtaagttttggggtccagggacgccctggtctaccggt

SEQ ID NO: 465776 - DNA, 423 bp, Homo sapiens; identical to SEQ ID NO: 444772
  misc_feature: HEFZJCU01CS43A.16.78.H01.1.454.heavy.3.raw

SEQ ID NO: 465777 - DNA, 503 bp, Homo sapiens
  misc_feature: HEFZJCU01D1TIE.48.23.C01.1.454.heavy.3.raw
agtatacatacacgaccggtgctcgatttagtacacgtgattagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgtatgcctttgatatgtggggccaagggacaatggtcc

SEQ ID NO: 465778 - DNA, 493 bp, Homo sapiens
  misc_feature: HEFZJCU01C8WKB.53.25.C03.1.454.heavy.3.raw
cgcgtatacacacgaccggtgctcgatttagtagtgtagatttgggtttgggggggtccctgagactctcctgtgcagcctctggattcaccttcagtatttatagcatgaattggatccgccaggctccagggaaggggctcgagtgggtctcatccattagtagtagtagtagttacaaatactacgcagactcagtgaagggccgattcaccgtctccagagacaacgccaagaactcactgtatctgcaaatgaatagcctgagagccgaggacacggctgtatatttctgtgcgagagatgacccatataacagtgactactactctgtggatgatgcttttgatgtctgggccaagggacaatagtcaccgtctcttcagcctccaccaagggcccatcggtcttcccctggcaccctcctccaagagcacctctgggggcacagcggccctgggctgcctggtcaaggactactcctcgtactgcg

SEQ ID NO: 465779 - DNA, 504 bp, Homo sapiens
  misc_feature: HEFZJCU01EYLVD.48.34.D01.1.454.heavy.3.raw
agtatacatacacgaccggtgctcgatttagatcgtctgtgttgggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttccccctcggcgccctcgctccaggagcacctccgagagcacagcggccctgggctgcctggtcaaggactacttcctatgtatact

SEQ ID NO: 465780 - DNA, 508 bp, Homo sapiens
  misc_feature: HEFZJCU01EDYWS.10.23.C01.1.454.heavy.3.raw
catagtagtgcacgaccggtgctcgatttagtacacgtgattagggattgggggggagaggagccccagccctgagattcccaggtgtttccattcagtgatcagcactgaacacagaggactcaccatggagttgggactgagctggattttccttttggctattttaaaaggtgttcagtgtgaagtgcagctggtggagtctgggggagcttggtacagcctggcaggtccctgagactctcctgtgcagcctctggattcagctttgatgaatatgccatggactgggtccggcaagttccagggaaggcctggagtgggtctcaggtattgattggaatagtggtaccattgcctatgcggactctgtgaagggccgattcaccatcaccagagacgacgccaggagctccctgtatctccaaatgaacagtctgagacctgacggacacggccttgtattactgtgtaagaggggagtcgtagggtttcaactattatagtt

SEQ ID NO: 465781 - DNA, 374 bp, Homo sapiens
  misc_feature: HEFZJCU01D0MN7.49.30.C08.1.454.heavy.3.raw
agtcgagagacacgaccggtgctcgatttagtctgacgtcaaagggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatccctggtcatcgtctcctcagcctccaccaagggcccatcggtcttccccctggcgccctgctccaggagcacctccgagagcacagcggccctgggctgcctggtcaaggactacttccctctctcgact

SEQ ID NO: 465782 - DNA, 526 bp, Homo sapiens
  misc_feature: HEFZJCU01B08Q4.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcacccatctccagagacaattacaagaacaccctttatctgcaaatagacagcctgagaccagacgacacggctgtctattattgcgcgagagagacacacgaacctactggccaatactatgggggcttgttctgggggccaggggaccctggtcatcgtctccccagccctccaccaagggcccatcggtcttccccctggccg

SEQ ID NO: 465783 - DNA, 523 bp, Homo sapiens; identical to SEQ ID NO: 446270
  misc_feature: HEFZJCU01C43O0.12.40.D07.1.454.heavy.3.raw

SEQ ID NO: 465784 - DNA, 315 bp, Homo sapiens; identical to SEQ ID NO: 444422
  misc_feature: HEFZJCU01CIS5N.47.84.H07.1.454.heavy.3.raw

SEQ ID NO: 465785 - DNA, 523 bp, Homo sapiens
  misc_feature: HEFZJCU01D9RWN.49.51.E07.1.454.heavy.3.raw
agtcgagagacacgaccggtgctcgatttagcatactctacaacacacaaagggggggagaggagccccagcccggagattcccaggtgtttccattcggtgatcagcactgaacacagagaactcaccatggagtttggactgagctgggttttccttgttgccatgttaaaaggtgtccagtgtgaagtgcggctggtggagtctgggggaggcgtggtgcagcctggggggtccctcagactctcctgtgcagcctccaacttcagctttggtgattttaccatgcactgggtccgccaaggtccgggcggggtctggagtgggtcgctcttattagtggagatgaagatggcacctactatgcagattctgtgaagggccggttcaccatctccagagacaacaggaaaaagtccctgtatctgcaaatgaacagtctgaggactgaggacaccgccttgtattattgtgtaaaggaaatcaaagagtcttacgatgtttggagtgcatattacgtacg

SEQ ID NO: 465786 - DNA, 513 bp, Homo sapiens; identical to SEQ ID NO: 464809
  misc_feature: HEFZJCU01BW173.13.9.A09.1.454.heavy.3.raw

SEQ ID NO: 465787 - DNA, 475 bp, Homo sapiens; identical to SEQ ID NO: 445138
  misc_feature: HEFZJCU01CSL71.3.39.D06.1.454.heavy.3.raw

SEQ ID NO: 465788 - DNA, 396 bp, Homo sapiens; identical to SEQ ID NO: 445898
  misc_feature: HEFZJCU01A9RH6.10.42.D09.1.454.heavy.3.raw

SEQ ID NO: 465789 - DNA, 477 bp, Homo sapiens
  misc_feature: HEFZJCU01AL8IF.26.78.H01.1.454.heavy.3.raw
agactatactcacgaccggtgctcgatttagtgtgagtagtttgggtttggggagacgagcccagcactggaagtcgccggtgtttccattcggtgatcatcactgaacacagaggactcaccatggagtttggctgagctgggttttcctcgttgctcttttaagaggtgtccagtgtcaggtgcagctggtggagtctgggggagcgtggtccagcctgggaggtccctgagactctcctgtgcagcctctggattcaccttcagttactatactatgcactgggtccgccaggctccaggcaaggggctggagtgggtggcagttatatcatatgatggaagcagcacatattacacagactccgtgaagggccgattcaccatctccagagacaatttgaagaacacgctgtatctgcaaatgaacagcctgagagctgaaagacacggctgtgttttactgtgcgagagaga

SEQ ID NO: 465790 - DNA, 484 bp, Homo sapiens; identical to SEQ ID NO: 446564
  misc_feature: HEFZJCU01BX9OG.19.13.B02.1.454.heavy.3.raw

SEQ ID NO: 465791 - DNA, 531 bp, Homo sapiens
  misc_feature: HEFZJCU01DAJPD.16.87.H10.1.454.heavy.3.raw
tgtactactccacgaccggtgctcgatttagcagtactgcgttgggtttggggcccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtggaaacagttatggttggggggtagttggggttttttttcgttacgttacgggatc

SEQ ID NO: 465792 - DNA, 505 bp, Homo sapiens
  misc_feature: HEFZJCU01EF2OC.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaatggacagcctaagagttgaggacacggctgtttattactgtacgaaagagggggatacgagtggcagctccaagtactac

SEQ ID NO: 465793 - DNA, 503 bp, Homo sapiens
  misc_feature: HEFZJCU01BDCZC.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagctttgatctctgggccaagggacactggtcaccgtctcttcagcctccaccaacgggcccatcggtcttccccctcggcgccctcgctcc

SEQ ID NO: 465794 - DNA, 526 bp, Homo sapiens
  misc_feature: HEFZJCU01C06J3.4.35.D02.1.454.heavy.3.raw
agcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtggctccatcagtaatttgtactggagctggatccggcagtcccaagggaagggactggagtgggttggatatatctttcacaccggggaccaccaactacaatccctccctcaagagtcgactcaccatgtcactggacacttccaagaaccagttctccctaaaattgacctctgtgagcgctgcagacacggccgtctattactgtgcgagactgcgggggctattatggttcggggagatcccagtggttttgatatatgggggccagggggacaggcggtcaccgtctcctttcagcct

SEQ ID NO: 465795 - DNA, 511 bp, Homo sapiens
  misc_feature: HEFZJCU01C97LI.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccagggaaggggctggagtgggtggccaacataaacaaagacggaagtcagaaaaactatgtggactctgtgaacgccgattcaccatctccagagacaacgccaagaattcactgtatttgcaaatgaacagcctgagaggcgaggacacggccgtgtattattgtgcgcgagatgatagtagactctacagtgacaggtggta

SEQ ID NO: 465796 - DNA, 523 bp, Homo sapiens
  misc_feature: HEFZJCU01EI426.16.86.H09.1.454.heavy.3.raw
  modified_base (501)..(501): a, c, t, g, unknown or other
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagacgacccctcgatagcagtggctggtccacttaggtttgactacgtgggggccaggggaancgtttggtccaccgtctccctc

SEQ ID NO: 465797 - DNA, 538 bp, Homo sapiens
  misc_feature: HEFZJCU01AK7JL.13.40.D07.1.454.heavy.3.raw
tcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccaggggggggcctggagtggcttggaagcatctctcaaagcgggacgaccgactataacccgtcttttaggagtcgagtctcgatttcaatagacaggtctaagacacaattctccctgagggtgacctctatgtcggccgcggacgcggccgtctattactgtgcgcgaggatctccgtcggaacacttcgtgacaagacaaaacgtccgaagtcgttatcactttgactcctggggccagggaaccctggtcagcgtctcttcagcctccaccaagggcccatcggtcttcccctggcaccctcctccaagagcacctctgggggcacagcggccctgggctgcct

SEQ ID NO: 465798 - DNA, 516 bp, Homo sapiens
  misc_feature: HEFZJCU01C8MEW.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgacgcctacggcacggcggcctttgactttcgtgggggcccaggggacg

SEQ ID NO: 465799 - DNA, 481 bp, Homo sapiens
  misc_feature: HEFZJCU01C9MIC.9.36.D03.1.454.heavy.3.raw
tgatacgtctcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttccccctggcgccctgctccaggagcacctccgagagcacagcggccctgggctgcctggtcaaggactacttccagacgtatca

SEQ ID NO: 465800 - DNA, 520 bp, Homo sapiens
  misc_feature: HEFZJCU01DBB0P.51.26.C04.1.454.heavy.3.raw
cgatcgtatacacgaccggtgctcgatttagtctagcgactttgggtttgggggctctgggagacgagcccagcactggaagtcgccggtgtttccattcggtgatcatcactgaacacagacatggagtttgggctgagctgggttttcctcgttgctcttttaagaggtgtccagtgtcaggtgcacctggtggagtctgggggaggcgtggtccagcctggggaggtccctcagactctcctgtgcagcctctggcttcaccttcgacaactttaatatgcactgggtgcgccgggctccaggcaaggggctggagtgggtggctgttataacttctgatgggaggtacaacatattactcagacgccgtgaggggccgattcaccatctccagagacaattccgggaacacactgtctctgcaaatgaacagcctgagagctgaggacagggctgtttattactgtgtgcgatccgacctcacgtggtacggggagttacttcctccgcgaacggt

SEQ ID NO: 465801 - DNA, 514 bp, Homo sapiens
  misc_feature: HEFZJCU01CVID7.10.35.D02.1.454.heavy.3.raw
  modified_base (225)..(225): a, c, t, g, unknown or other
catagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtctgggggaggcttggttaanccgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccagaagactgtgggaaggga

SEQ ID NO: 465802 - DNA, 524 bp, Homo sapiens
  misc_feature: HEFZJCU01DT4PR.13.21.B10.1.454.heavy.3.raw
  modified_base (487)..(487): a, c, t, g, unknown or other
tcacgtactacacgaccggtgctcgatttagtgtcgtcgcaaagagagaggagccttagccctggactccaaggcctttccacttggtgatcagcactgagcacagaggactcaccaatggcattggggctgaactgggttttccttgttgctattttagaaggtgtccagtgtgaggtgcaactggtggagtctgggggaggcttggtccagcctggggggtccctgagactctcctgtcaagcctctgggttcagcttcagtgtatattggatgagctgggtccgccagactccagggaaggggctggagtgggtggccaacataaacacagacggaagtgacccatactatgcggactctgtgaagggccgattcaccatctccagagacaacgccaagaactcactatatttgcaaatggaccgcctgagagacgaggacacggctatgtattactgtgcgagagatgagagtgggctaacgnggttggggccgggggaaccctgggtcaccgtcaaccg

SEQ ID NO: 465803 - DNA, 493 bp, Homo sapiens; identical to SEQ ID NO: 455531
  misc_feature: HEFZJCU01CKKGL.47.85.H08.1.454.heavy.3.raw

SEQ ID NO: 465804 - DNA, 491 bp, Homo sapiens; identical to SEQ ID NO: 445333
  misc_feature: HEFZJCU01DANYX.19.53.E09.1.454.heavy.3.raw

SEQ ID NO: 465805 - DNA, 484 bp, Homo sapiens; identical to SEQ ID NO: 445311
  misc_feature: HEFZJCU01AYKKG.11.23.C01.1.454.heavy.3.raw

SEQ ID NO: 465806 - DNA, 489 bp, Homo sapiens
  misc_feature: HEFZJCU01C7QML.51.52.E08.1.454.heavy.3.raw
cgatcgtatacacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtttgggactgaggtgaagaagcctggggcctcagtgaaggtctcctgcaagacttctggatacaccttcaccgactactatatgcactgggtgcgacaggcccctggacaagggcttgagtggatgggatggatcgaccctaagaatggtgccacaaactatgcacagacttttcagggctgggtcaccatgaccagcgacacatctagcaacacagtctacatggagttgaccagcctgaccgacacggccgtgtatttttgtgtgagagattttcggacaatccagagacccctgt

SEQ ID NO: 465807 - DNA, 497 bp, Homo sapiens
  misc_feature: HEFZJCU01CBPJ2.21.40.D07.1.454.heavy.3.raw
tcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttagtagctattggatgagctgggtccgccaggctccagggaagggctggagtgggtggccaacataaagcaagatggaagtgagacatactatgtggactctgtgaagggccgattcaccatctccagagacaacgccaagagctcactgtatctgcaaatgaacagcctgagagtcgaggacacggctgtgtattactgtgcgagagatccccgtccggtatacgg

SEQ ID NO: 465808 - DNA, 487 bp, Homo sapiens
  misc_feature: HEFZJCU01DU08O.4.6.A06.1.454.heavy.3.raw
agcactgtagcacgaccggtgctcgatttagatctactgacagggtctcccaggccttgtgaagacctcggagaccctgtccctcacttgcactgtctctggtggctccatcagcagtttctatggggcttggatccggcagcccccagggaagggactggaatggattgggaacacctattacagtgggagccccagctacaatccctccctcaagagtcgactcaccatctcggctgacccgtccaagaatcagttctccctgaggctgacctctgtgaccgccgctgacacggccgtctattactgtgggagacagtgcagtggtggttcgtgccccgagtactggggccgcggaatcttggtcaccgtctcctcagcctccaccaagggcccatcggtcttcccctggcgccctgctccaggagcacctccgagagcacagcggccctgggctgcctggtcaggactacttccctacagtgct

SEQ ID NO: 465809 - DNA, 506 bp, Homo sapiens
  misc_feature: HEFZJCU01ELJIH.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgcctgctccagagcacctctgggggcacagcggccctgggctgcctggtcaggactactccata

SEQ ID NO: 465810 - DNA, 502 bp, Homo sapiens
  misc_feature: HEFZJCU01EL17F.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttggagtgggtggggtggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacatttgataggctctagtggactggacttcgtc

SEQ ID NO: 465811 - DNA, 500 bp, Homo sapiens
  misc_feature: HEFZJCU01E0W9O.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtggggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagaggagctattatctggaccccgat

SEQ ID NO: 465812 - DNA, 508 bp, Homo sapiens
  misc_feature: HEFZJCU01EFW7R.48.81.H04.1.454.heavy.3.raw
agtatacatacacgaccggtgctcgatttagtagtgtagattcgcgggggagcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcgcggggaggtggacggagctcgggttttcggagttatcatctactacttt

SEQ ID NO: 465813 - DNA, 489 bp, Homo sapiens
  misc_feature: HEFZJCU01CIOJM.47.85.H08.1.454.heavy.3.raw
agctcacgtacacgaccggtgctcgatttagtatcactcagccggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggtcgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctccgagagcacagcggccctgggctgcctggtcaaggactacttcctacgtgagct

SEQ ID NO: 465814 - DNA, 536 bp, Homo sapiens
  misc_feature: HEFZJCU01CQJHP.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaagtaatggctgtgtttattggggccagggagcccgtggtctaccg

SEQ ID NO: 465815 - DNA, 519 bp, Homo sapiens
  misc_feature: HEFZJCU01EAWGX.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctctggggcacagcggccctgggctgcctggtcaaggactacttccgagtagtacta

SEQ ID NO: 465816 - DNA, 497 bp, Homo sapiens
  misc_feature: HEFZJCU01B3VK8.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgaggctgtgagcgccgcagacacggccgtgtattactgtgcgagactggccgcaacagactacggtggcaactcctatgctttgatatctgggccaagggac

SEQ ID NO: 465817 - DNA, 523 bp, Homo sapiens
  misc_feature: HEFZJCU01DMTUV.52.22.B11.1.454.heavy.3.raw
  modified_base (387)..(387): a, c, t, g, unknown or other
cgcagtacgacacgaccggtgctcgatttagacgacagctcagggggggagaggagccccagccgtgagattcccaggagattccacttggtgatcagcactgaacacagacctccaaccatggagtttgggcttagctgcgttttccttgttgctattttaaaaggtgtccaatgtgaggtgcagctggttgagtctgggggaggcttggtacagccagggcggtccctgagactctcctgtgtaacctcaggattcatgtttggtgattatggaatgacctgggtccgccaggctccaggggagggcctggagtgggtagctttcgtagcagaagactgaaggtgggacaacagaatacgccgcgtctgtgaaaggcagatttancatctcaagagacgattccaaaggcatcgcctatctgcaaatgaacagcctgaaaccgaggacacagccgtgtattttgtactagagtcttcttgtattactatgatactagtggttttacaggtaggcggggacg

SEQ ID NO: 465818 - DNA, 493 bp, Homo sapiens
  misc_feature: HEFZJCU01BBIRT.11.38.D05.1.454.heavy.3.raw
cgagagataccacgaccggtgctcgatttagtatctgatagttgggtttgggggaggcttggtacagcctggggggtccctgagactctcctgtgcagcgtctggattcacctttagcagctatgccatgacctgggtccgccaggctccagggaaggggctggagtgggtctcagctattagtgatagtggtggtagcacatactacgcagactccggtgaagggccggttcaccatctccagagacaattccatgaacacgctgtatctgcaaatgaacagcctgagagccgaggacacggccgtatattactgtgcgcagatagattgtagtggtggtagctgctactggggccagggaaccctggtcaccgtctcctcagcctccaccaagggcccatcggtcttcccctggccaccctcctccaagagcacctctgggggcacagcggccctgggctgcctggtcaaggactacttccgtatctctcg

SEQ ID NO: 465819 - DNA, 517 bp, Homo sapiens
  misc_feature: HEFZJCU01APHGQ.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctcggcgccctcgctccaggagcacctccgagagcacagcggccctgggctcg

SEQ ID NO: 465820 - DNA, 508 bp, Homo sapiens
  misc_feature: HEFZJCU01EP6UF.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggcccgtatatttctgcgcgagagacgtaaaagtgacgtggtagttccggggggacacatgacaccg

SEQ ID NO: 465821 - DNA, 520 bp, Homo sapiens
  misc_feature: HEFZJCU01DWH40.48.57.F02.1.454.heavy.3.raw
  modified_base (461)..(461): a, c, t, g, unknown or other
agtatacatacacgaccggtgctcgatttagctcgatatagttgggtttggggggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactgggcctggatccgccagccccccgggaagggactggaatggattgggagtatctattatacagggagcacctactacaacccgtccctcaagagtcgagtcaccatctccgcagacacgtccaagaaccagttctccctgaggctgagctctgtgaccgccgcagacacggctgtctattactgtgcgagaagtgggtcgtggcagtggctggtacgtggctctcngtggttcacccctggggccaggggatacctggtcaccgtctcctcagctttccaccaac

SEQ ID NO: 465822 - DNA, 501 bp, Homo sapiens
  misc_feature: HEFZJCU01BUBXN.17.25.C03.1.454.heavy.3.raw
  modified_base (450)..(450): a, c, t, g, unknown or other
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattcngtgcgagagtcccacgatccggtgagcctaggcagcggcctttgacttctc

SEQ ID NO: 465823 - DNA, 497 bp, Homo sapiens; identical to SEQ ID NO: 445413
  misc_feature: HEFZJCU01COSPS.16.37.D04.1.454.heavy.3.raw

SEQ ID NO: 465824 - DNA, 515 bp, Homo sapiens
  misc_feature: HEFZJCU01DUDRJ.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagacgtcccacgactccgggtgagccgtacggcaggcggcctttgacttcgtggggccaggggacg

SEQ ID NO: 465825 - DNA, 517 bp, Homo sapiens
  misc_feature: HEFZJCU01D9141.17.43.D10.1.454.heavy.3.raw
cgtagactagcacgaccggtgctcgatttagactagcagtaaggggacataacaaccacattcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggattctggaggcaacttcaggaactactttattagttgggtacgtcaggcccctggacaggggcttgagtggatgggagggatcatccctgtctctggtacggcaaattacgcacagaagttccagggcagagtcacgattaccgcggacgaatctacgaacacagcctacatggatctgaacatcctgagatctgacgacacggccgtttattactgtgcgagagcaactagtgcaccttactactttgtctactggggccagggaaccctggtcaccgtctcctcacg

SEQ ID NO: 465826 - DNA, 493 bp, Homo sapiens
  misc_feature: HEFZJCU01AP91Q.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctgggccgtggcaccctgctgactgtctcctcagcctccaccaagggcccatcgtcttcccctggcgcctgctcaggagcacctccgagagcacagccggcctgggctgcctggtcaaggactaccg

SEQ ID NO: 465827 - DNA, 484 bp, Homo sapiens; identical to SEQ ID NO: 449584
  misc_feature: HEFZJCU01DCR7X.10.35.D02.1.454.heavy.3.raw

SEQ ID NO: 465828 - DNA, 507 bp, Homo sapiens
  misc_feature: HEFZJCU01EEKW5.13.33.C11.1.454.heavy.3.raw
tcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatgaactgaggagccgtaagatctgacgacacggccgtttattattgtgcaataagaattgcaaacgatgtcttttgatatgtggggaccgaagggactacg

SEQ ID NO: 465829 - DNA, 507 bp, Homo sapiens
  misc_feature: HEFZJCU01BGGZ0.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacaccggccacctattattgtgcgcgacatgactacgctcaattctggggccagggacg

SEQ ID NO: 465830 - DNA, 512 bp, Homo sapiens
  misc_feature: HEFZJCU01BXF2N.12.27.C05.1.454.heavy.3.raw
atacgacgtacacgaccggtgctcgatttagacgcgatcgaagggtttggggtctgagagaggagcccagccctgggattttcaggtgttttcatttggtgatcaggactgaacagagagaactcaccatggagtttgggctgagctggctttttcttgtggctattttaaaaggtgtccagtgtgaggtgcaactggtggagtctgggggaggcttggtacagccgggggggtccctgagactctcctgtgcaggctctggattcatctttaacaactatgccatgagctgggtccaccaggctccagggaagggctggagtgggtctcagctattagtaatagtggtgatagcacatcctacgcagactccgtgaagggccgcttcaccatctccagagacaattccaagaacacgctgtatctccaaatgaacagtctcagagccgaggacacggcccatatattacctgtgcgaaagacacagccgcagtttggggggagtcatccgt

SEQ ID NO: 465831 - DNA, 506 bp, Homo sapiens; identical to SEQ ID NO: 448313
  misc_feature: HEFZJCU01DKK7Z.52.34.D01.1.454.heavy.3.raw

SEQ ID NO: 465832 - DNA, 532 bp, Homo sapiens
  misc_feature: HEFZJCU01D8PPZ.13.28.C06.1.454.heavy.3.raw
tcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagcctggggggtccctgagactctcctgtgtagcctctggatttgtttttagtgactattggatgagttgggtccgccaggctccagggaaggggctggagtgggtggccaacataaagtacgatgaagttgagataaattatttggactctgtgaagggccgattcaccatctcgagggacaacgccaagaactcgctgtatctgcaaatggagagcctgagagccgaggacacggctgtatattattgtgtgagtattagcgcactactttgactactggggcctagggaaccctggtccaccgt

SEQ ID NO: 465833 - DNA, 537 bp, Homo sapiens
  misc_feature: HEFZJCU01ADPOL.13.28.C06.1.454.heavy.3.raw
tcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagcctggggggtccctgagactctcctgtgtagcctctggatttgtttttagtgactattggatgagttgggtccgccaggctccagggaaggggctggagtgggtggccaacataaagtacgatgaagttgagataaattatttggactctgtgaagggccgattcaccatctcgagggacaacgccaagaactcgctgtatctgcaaatggaagagcctgagagccgaggacacggctgtatattattgtgtgagattagcgcacgtactttgactactggggccaggggaacccctgggtccaccgtcc

SEQ ID NO: 465834 - DNA, 487 bp, Homo sapiens; identical to SEQ ID NO: 446769
  misc_feature: HEFZJCU01EKHOS.22.86.H09.1.454.heavy.3.raw

SEQ ID NO: 465835 - DNA, 507 bp, Homo sapiens; identical to SEQ ID NO: 460264
  misc_feature: HEFZJCU01AY0J2.18.50.E06.1.454.heavy.3.raw

SEQ ID NO: 465836 - DNA, 515 bp, Homo sapiens
  misc_feature: HEFZJCU01CLD6S.9.70.G04.1.454.heavy.3.raw
tgatacgtctcacgaccggtgctcgatttagtgtagtgtgaagggaaagggcctgtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaaactcctactacggtctggacgtctggggccagggacccaggtcaccgtctcctcagcctccaccaagggcccactcggtcttccccctggcgccctgctccaggagcacctccgagagcacagcggccctgggctgcctggtcaaggactacttccagacgtatca

SEQ ID NO: 465837 - DNA, 503 bp, Homo sapiens
  misc_feature: HEFZJCU01CZLU7.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaaccacagtctacatgcaactgacgagcctgagagctgacgacacggccgtctattactgtgcgagaatgttttctgtcatcgtacaatttgataggctctatggactggacttcgtc

SEQ ID NO: 465838 - DNA, 519 bp, Homo sapiens
  misc_feature: HEFZJCU01DIAJ8.49.65.F10.1.454.heavy.3.raw
agtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgaagcctctggattcaccttcaagaactttggcatgcactgggtccgccaggctccaggcacggggctggagtgggtggcagttatctcagatgatggaagtaaaaagtactattcggactccttgaagggccgattcaccatctccagagacaattccaagaacaccttgcatctacaaatgcacagtctgagacctgaggacacggctgtgtattactgtgcgaagggggaggggatttttgctatttggacccacttgactactggggccgaac

SEQ ID NO: 465839 - DNA, 495 bp, Homo sapiens
  misc_feature: HEFZJCU01B1VSP.11.73.G07.1.454.heavy.3.raw
cgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggaggcttggtacagcctggacggtccctgagactctcctgtgcagcctctggatacatcttcaaaagtttcgaaatgagctgggtccgccaggctcctgggaaggggccggagtggatttcatacatcagtagtagtggtaacaccttgtactatgcagactctgtgaagggccgattcaccatctccagagacaacgccaagaattcactgtttctgcaaatgaacagcctgagagacgaggatacggctatttactattgtgcgcgatcgacagaaaagcggtaggcc

SEQ ID NO: 465840 - DNA, 497 bp, Homo sapiens
  misc_feature: HEFZJCU01D1E4Y.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgctttgatatctgggccagggac

SEQ ID NO: 465841 - DNA, 526 bp, Homo sapiens
  misc_feature: HEFZJCU01DMKTU.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttggttctgggggtccaggggacctggtcagtcgtctccccagcctccaccaacgggcccatcggtccttcccctggccg

SEQ ID NO: 465842 - DNA, 500 bp, Homo sapiens; identical to SEQ ID NO: 447017
  misc_feature: HEFZJCU01DIBCT.13.12.B01.1.454.heavy.3.raw

SEQ ID NO: 465843 - DNA, 496 bp, Homo sapiens
  misc_feature: HEFZJCU01DL27N.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtgctacgagtactggtacttcgatctctgggccgtggcaccctgctgactgtctcctcagcctccaccaagggcccatcggtcttcccctggcgccctgctccaggagcacctccgagagcacagcggcccgtggctgcctggtcaaggactaccg

SEQ ID NO: 465844 - DNA, 506 bp, Homo sapiens
  misc_feature: HEFZJCU01B90OV.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgtatgcctttgatatgtggggtccaaggggacaaagtggtcaccggtctt

SEQ ID NO: 465845 - DNA, 487 bp, Homo sapiens
  misc_feature: HEFZJCU01EMET2.12.75.G09.1.454.heavy.3.raw
atacgacgtacacgaccggtgctcgatttagtatagacatcagggggcatcacataacaaccacattcctcctctaaagaagcccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattaccgcggacgaatccacgaccacagcctacatagagctgcgcagcctgagatctgaagacacgggccatttattactgtgcgagagatgcagggccctcccgacatcggtttta

SEQ ID NO: 465846 - DNA, 524 bp, Homo sapiens
  misc_feature: HEFZJCU01DMDZZ.53.10.A10.1.454.heavy.3.raw
cgcgtatacacacgaccggtgctcgatttagcgtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgcctccaggggggacctttggggtttcgacccctggggccagggaaccctggtcaccgtctcctcagcctccaccaagggccatcggtcttcccctggcaccctcctccaagagcacctctgggggcacgagcc

SEQ ID NO: 465847 - DNA, 533 bp, Homo sapiens
  misc_feature: HEFZJCU01E1OF3.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactatggggccagggaaccctggtcaccgtctcctcagcctccaccaagggccc

SEQ ID NO: 465848 - DNA, 499 bp, Homo sapiens; identical to SEQ ID NO: 450485
  misc_feature: HEFZJCU01CIND3.11.73.G07.1.454.heavy.3.raw

SEQ ID NO: 465849 - DNA, 522 bp, Homo sapiens
  misc_feature: HEFZJCU01BO1H7.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagcgtggtttcgtgtaggctattcaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttactgaccctggggccgggaacctggtcaccgtctccccaccctccaccg

SEQ ID NO: 465850 - DNA, 491 bp, Homo sapiens
  misc_feature: HEFZJCU01AX3MR.13.85.H08.1.454.heavy.3.raw
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtcttgagtggatgggactaatcactcccaatggtgatgggactgcctacgcacagaagtttcagggcagagtcaccatgaccagggacacgtccacgagaacagactaatttggagttgagcagcctgagatctgacgacacggccgtttattactgtgcgcgagataatagtcacaactggaacggcgtttt

SEQ ID NO: 465851 - DNA, 521 bp, Homo sapiens
  misc_feature: HEFZJCU01DO5MS.13.71.G05.1.454.heavy.3.raw
tcacgtactacacgaccggtgctcgatttagtgtcgtcgcaagagagaggagccttagccctggactccaaggcctttccacttggtgatcagcactgagcacagaggactcaccatggaattggggctgagctgggttttccttgttgctattttagaaggtgtccagtgtgaggtgcagctggtggagtctggggggggcttggtccagcctggggggtccctgagactctcctgtgcagcctctggattcactttttagtaggtattggatgggttgggtccgccagactccagagaagggactggagtgggtggccaacataaaggaagatggaagtgaaagatactatgtggactctgtgaagggccgattcaccatctccagagacaacgccaagaactcactgtatctgcagatgaccagcctgagagtcgaggatacggctgtgtattattgtgcgagagagtgggggcacgacatttttgtagagggttgtacgtgggggccaggggaccgg

SEQ ID NO: 465852 - DNA, 515 bp, Homo sapiens
  misc_feature: HEFZJCU01BAN1U.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagactttttctcagaacacactgtctcttcaaatgaacagcctgagggccgaggacacggccgtctattattgtgtgagagtttatggcgatggctggtggacagatcactgggggccac

SEQ ID NO: 465853 - DNA, 494 bp, Homo sapiens
  misc_feature: HEFZJCU01CSAK9.11.71.G05.1.454.heavy.3.raw
cgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgacgaagtatttctata

SEQ ID NO: 465854 - DNA, 495 bp, Homo sapiens; identical to SEQ ID NO: 451022
  misc_feature: HEFZJCU01CFJ1R.16.37.D04.1.454.heavy.3.raw

SEQ ID NO: 465855 - DNA, 512 bp, Homo sapiens
  misc_feature: HEFZJCU01AYY9W.4.12.B01.1.454.heavy.3.raw
agcactgtagcacgaccggtgctcgatttagtagtgtagattccacggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaacacagggactgcagtggattggatacatctacttcagtgggaaccccaactacaacccctccctcaggagtccagtcgccatatccctggactcgtccaacaaccagatctccctgacgatgacatctgtgaccgctgcggacacagccgtttattactgtgcgcgatctgggcgactcagtgactatggtatggacgtctggggccaagggaccacggtcatcgtctcctcagcctccaccaaggcccatcggtcttcccctggccta

SEQ ID NO: 465856 - DNA, 499 bp, Homo sapiens
  misc_feature: HEFZJCU01AU79T.7.85.H08.1.454.heavy.3.raw
cgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctggggggtccctgagactctcctgtgcagcctctggatttaccttcagtacttatggcatgaactgggtccgccaggctccagggaagggctgcagtgggtttcacacattaatactggaagtaggaccataacttacacagactctgtgaagggccgattcaccacctccagagacgacgccaagaactcactgtctctgcaaatgaacagcctgagagtcgaggacacggctgtgtattactgtgcgagagatccggaggggacgtatgacc

SEQ ID NO: 465857 - DNA, 497 bp, Homo sapiens
  misc_feature: HEFZJCU01EB085.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaaagtgacgtggtagttccgggggacac

SEQ ID NO: 465858 - DNA, 519 bp, Homo sapiens
  misc_feature: HEFZJCU01EBG9O.15.16.B05.1.454.heavy.3.raw
tctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaacaaacctgagagccgaggacacggctgtgtattactgtgtgagagatgttctgcgttggggccagggaaccctggtctaccg

SEQ ID NO: 465859 - DNA, 543 bp, Homo sapiens
  misc_feature: HEFZJCU01EUQ2S.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggcttttcttgtggctttttaaaaggtgcccagtgtgaggtgcaactgttggagtctggggaggcttggtacagccggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacaactgtatctgcaattaaccagcctgagagtcgaggacacggccctttattactgtgcgaaggatcgcccctataatggtggttggatcggggagtttggttcctggggccagggaaccctggtctaccg

SEQ ID NO: 465860 - DNA, 506 bp, Homo sapiens; identical to SEQ ID NO: 454268
  misc_feature: HEFZJCU01CHQOB.10.38.D05.1.454.heavy.3.raw

SEQ ID NO: 465861 - DNA, 500 bp, Homo sapiens
  misc_feature: HEFZJCU01DLMTD.40.34.D01.1.454.heavy.3.raw
tctagcgactcacgaccggtgctcgatttagatcgtctgtgccgaggtgcagctggtgcagtctggagcagaggtgaaaaagcccggggagtctctgaagatctcctgtaagggttttggatacaactttaccatctactggatcgcctgggtgcgccagatgcccgggaaaggcctagagtgggtgggaatcgtctatcctgacgactctgataccagatacagcccgtccttccaaggccaggtcaccatctcagccgacaagtccgtcaataccgcctacctgcagtggagcagtctgcaggcctcggacaccgccatgtacttctgtgcgagagggttcggggatgactactggggccagggaaccctggtcaccgtctcttcagcttccaccaagggcccatcggtcttcccctggcgccctgctccaggagcacctcctgggggcacagcggcccgtcgggctgcctggtcaaggactacttccagtcgctaga

SEQ ID NO: 465862 - DNA, 500 bp, Homo sapiens; identical to SEQ ID NO: 450218
  misc_feature: HEFZJCU01CSMGK.17.10.A10.1.454.heavy.3.raw

SEQ ID NO: 465863 - DNA, 529 bp, Homo sapiens
  misc_feature: HEFZJCU01CB5SL.53.64.F09.1.454.heavy.3.raw
cgcgtatacacacgaccggtgctcgatttagcgcgtatacaagggggagagaggagcccagccctgggattttcaggtgttttcatgtggtgatcaggactgaacagagagaactcaccatggagtctgggctgacgtggctttttcttgtggctattttaaaaggtgtccagtgcgacgtgcagctggtggagtcggggggaggcttggtacagccgggggggtccctgagactctcctgtagagtctctggcttcacctttggagtctatgacatgagttgggtccgccaggctccggggaagggctggagtgggtctcaacgatcagtgatagcggaagtaccacaaactacgccgcctccgtgaagggccgatgcaccgtctccagagacaattcgaaggacactttatatctgcaactcaacagactgacaaccgctgacacggccgtctattactgtgtcaaagaagacggaccgctggacgaggagccagaggaaaatcactactttgactactggggccaa

SEQ ID NO: 465864 - DNA, 503 bp, Homo sapiens
  misc_feature: HEFZJCU01DHN8O.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaatttgataggcttctatggactggacttcgtc

SEQ ID NO: 465865 - DNA, 395 bp, Homo sapiens; identical to SEQ ID NO: 444517
  misc_feature: HEFZJCU01ARSNY.16.68.G02.1.454.heavy.3.raw

SEQ ID NO: 465866 - DNA, 396 bp, Homo sapiens; identical to SEQ ID NO: 444469
  misc_feature: HEFZJCU01BI21X.47.46.E02.1.454.heavy.3.raw

SEQ ID NO: 465867 - DNA, 530 bp, Homo sapiens
  misc_feature: HEFZJCU01DUO03.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcgtttgtcttctccatggatacctctgtcgggacggcttatctgcagataaccaaccttcaacctgacgacactgccgtttatttttgttacgagagcgtcgtctgtcagtggaattgactactgggccagggaaccctggtcaccgtctcctcagcctccaccaggg

SEQ ID NO: 465868 - DNA, 517 bp, Homo sapiens
  misc_feature: HEFZJCU01BKHZ6.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgattttttggatgtctggggccaaggtacagcggtcaccgtcgcctcagcctccaccaagggcccatcggtcttccccctggcaccctcctccaagagcacctctgggggc

SEQ ID NO: 465869 - DNA, 522 bp, Homo sapiens
  misc_feature: HEFZJCU01CJCKJ.40.67.G01.1.454.heavy.3.raw
tctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattcttatgggcgctcccactacagtgcggccctccagagtcgagccctcatatccatagacacgtccaagaaccagttttccctgacgctgacgtctgtgaccgccgcagacacggctgtctattattgtgcgagactagccttctgtagtggggtacttgcaacccgggatactactccaccttcggcttggacatctggggccgaggggcctcc

SEQ ID NO: 465870 - DNA, 529 bp, Homo sapiens
  misc_feature: HEFZJCU01C9T2C.52.22.B11.1.454.heavy.3.raw
  modified_base (502)..(502): a, c, t, g, unknown or other
cgcagtacgacacgaccggtgctcgatttagacgacagctcaggggggagaggagccccagccgtgagattcccaggagattccacttggtgatcagcactgaacacagacctccaaccatggagtttgggcttagctgcgttttccttgttgctattttaaaaggtgtccaatgtgaggtgcagctggttgagtctgggggaggcttggtacagccagggcggtccctgagactctcctgtgtaacctcaggattcatgtttggtgattatggaatgacctgggtccgccaggctccaggggagggcctggagtgggtagctttcgttagcagaaagactgaaggtgggacaacagaatacgccgcgtctgtgaaagggcagattttatcatctcaagaagacgattccaaaggcatcgctatctgcaaatgaacagcctgaaaaccgaggacacaagccggtgttatttttgtacttagagtcttcttgtattactatgntactagtggttttacaaggtgcggggc

SEQ ID NO: 465871 - DNA, 494 bp, Homo sapiens; identical to SEQ ID NO: 450533
  misc_feature: HEFZJCU01DETG5.10.21.B10.1.454.heavy.3.raw

SEQ ID NO: 465872 - DNA, 517 bp, Homo sapiens
  misc_feature: HEFZJCU01EELUM.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaatgaacagcctaagtcctgaggacacgggtgtatactactgtacgaaggaggggggaaccgagcgggagttcaagtactcctttgacgtctgggccgtac

SEQ ID NO: 465873 - DNA, 502 bp, Homo sapiens; identical to SEQ ID NO: 459231
  misc_feature: HEFZJCU01CWFE2.17.25.C03.1.454.heavy.3.raw

SEQ ID NO: 465874 - DNA, 537 bp, Homo sapiens
  misc_feature: HEFZJCU01AQJIH.13.35.D02.1.454.heavy.3.raw
tcacgtactacacgaccggtgctcgatttagcacacgatagttgggtttgggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtctggggggggcttggttaagcctggggggtccctcagactctcctgtgcaacctctggattcattttctctgacgcctggttgagctgggtccgccaggctcccgggaagggctggagtgggttggccgtattaaaggtagaagacatggtcggacaacagactacagtgttcccgtgaaaggcagattcactatctcaagagatgactcaaaagaaatgatatatctgcaaatgaacaacctgaaaagcgaggacacaggcgtgtattactgtaccacagatgggccagatgcaaatggccgcgacgagttcgactactgggggcccggaacg

SEQ ID NO: 465875 - DNA, 547 bp, Homo sapiens
  misc_feature: HEFZJCU01EPV5H.40.57.F02.1.454.heavy.3.raw
tctagcgactcacgaccggtgctcgatttagctcgatatagttgggtttggggtctgagagaggagcccagccctgggactttcaggtgttttcatttggtgatcaggactgaacagagagacctcaccatggactttgggctgaggtggcttttcttgtggctcttttaaaaggtgtccagtgtgaggtgcagttattggagtcggggggaggcttaatacagccgggggggtccctgagactcgcctgtacagcctctggactcacctttagaaatgatgccttgagctgggtccgccaggctgcagggaaggggctggaatgggtctctattattagtggtaggacagatagtcgaaactacgctgactccgtgaagggccgcttcaccatctccagagacgtttccaacaacacgatctttctggagatgaatagcctgagagccgaggacacggaccaaatattactgtgacgaaaagaccctctattgtagtggtggtaattgtaactactactttgattcctggggtccagggtaacccg

SEQ ID NO: 465876 - DNA, 396 bp, Homo sapiens; identical to SEQ ID NO: 444433
  misc_feature: HEFZJCU01AK8IT.47.59.F04.1.454.heavy.3.raw

SEQ ID NO: 465877 - DNA, 529 bp, Homo sapiens
  misc_feature: HEFZJCU01DJDGO.17.34.D01.1.454.heavy.3.raw
cgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcctttttacacctcccttgacttctggggccatgaaccccggtcaccgt

SEQ ID NO: 465878 - DNA, 520 bp, Homo sapiens
  misc_feature: HEFZJCU01EE4W9.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgtctggggccaggggaccctggtcatcgtctccccagcctccaccaagggcccatcggtcttcccctggcg

SEQ ID NO: 465879 - DNA, 507 bp, Homo sapiens; identical to SEQ ID NO: 450163
  misc_feature: HEFZJCU01EICVW.16.21.B10.1.454.heavy.3.raw

SEQ ID NO: 465880 - DNA, 508 bp, Homo sapiens
  misc_feature: HEFZJCU01CTV81.51.21.B10.1.454.heavy.3.raw
cgatcgtatacacgaccggtgctcgatttagtgtcgtcgcaagggggcatcatccaacaaccacatcccttctctacagaagcctctgagaggaaagttcttcaccatggactggacctggagggtcttctgcttgctggctgtagctccaggtgctcactccctggtgcagctggtgcagtctggggctgaggtgaagaagcctggggcctcagtgacgatttcctgtaggacatctggatacacgttcaccggctattttatgtactgggtgcgacaggcccctggacaaggccttgagtggatgggaaagatcaaccctagtggtggtaccacaagttacgcccagaaattccagggcagagtctccatgaccagaaatacgtccgcgaggacagtctacatggagttgagcagcctgagaactgacgacacggccatatattactgtgcgagagaccttgctggtccttttgactttctggggccagggaaccctggtcaccgt

SEQ ID NO: 465881 - DNA, 534 bp, Homo sapiens; identical to SEQ ID NO: 446321
  misc_feature: HEFZJCU01CZ3VN.22.38.D05.1.454.heavy.3.raw

SEQ ID NO: 465882 - DNA, 506 bp, Homo sapiens
  misc_feature: HEFZJCU01A3DOL.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagtctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatccctccgggacagacttaccatgaccacgaactcctccataaacacagcctacatggagttgaggagcctgacatctgacgacacggccgtctattactgtgcgagagtcccacgatccggtgagcctacggcagcggcctttgacttctggggccaggg

SEQ ID NO: 465883 - DNA, 403 bp, Homo sapiens; identical to SEQ ID NO: 444658
  misc_feature: HEFZJCU01DYX0S.14.60.F05.1.454.heavy.3.raw

SEQ ID NO: 465884 - DNA, 500 bp, Homo sapiens
  misc_feature: HEFZJCU01DQ6V2.4.58.F03.1.454.heavy.3.raw
agcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaaagccttgagtggatgggatcgatcaactctggcaatggcaacacaaaaatattcacagaagttacagggcagagtcaccattaccagggacacatccgcgaacacagcctacatggagctgagcagcctgacatctgaagacacggctgtgtattactgttcgagacgggctagtctgggatctagttatagtgactcgtcgttctgggg

SEQ ID NO: 465885 - DNA, 526 bp, Homo sapiens
  misc_feature: HEFZJCU01DJRU0.17.33.C11.1.454.heavy.3.raw
cgtagactagcacgaccggtgctcgatttagagtgagctcgttgggtttgggctcaactctcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcgggagttattagtccctactttgactactggggccagggaactctggtcaccgtctccgcagccctccaccaagggcccatcggtcttcccctggcaccctcctccaagagcacctctgggggcacagcgcccgtgggctgcctggttaac

SEQ ID NO: 465886 - DNA, 487 bp, Homo sapiens; identical to SEQ ID NO: 447190
  misc_feature: HEFZJCU01C9MHH.3.48.E04.1.454.heavy.3.raw

SEQ ID NO: 465887 - DNA, 506 bp, Homo sapiens
  misc_feature: HEFZJCU01AVABY.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgacgcctacggcagcggcctttgactttcgtc

SEQ ID NO: 465888 - DNA, 514 bp, Homo sapiens
  misc_feature: HEFZJCU01CY634.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgtatctctggggccgtggcaccctggtcactgtctcctcggcttccaccaagggcccatcggtcttcccctggcgccctgctccaggagcacctctggggcacgagcggccg

SEQ ID NO: 465889 - DNA, 527 bp, Homo sapiens
  misc_feature: HEFZJCU01E0BDP.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatcctccagagacaactctaagaacacgctgtttcttctaaatgaacagcctgagagccgatgacacggccgtgtattactgtgcgagagatggggcccagaacgttactacgctatggacgtctggggccaagggaccac

SEQ ID NO: 465890 - DNA, 530 bp, Homo sapiens
  misc_feature: HEFZJCU01CV4QN.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaaggg

SEQ ID NO: 465891 - DNA, 462 bp, Homo sapiens
  misc_feature: HEFZJCU01DHCFN.4.6.A06.1.454.heavy.3.raw
agcactgtagcacgaccggtgctcgatttagatctactgacagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcaccaccgcctacctgcagtggagcagcctgaaggcctcggacaccgccatgtattactgtgcgagcgcctatagatatagcagcacctggtacatgtggcgtggtgcttttgatatctggggccaagggacaatggtcaccgtctcttcagcctccaccaagggcccatcggtcttccccctggcaccctcctccaagagcacctctgggggcacagcggccctgggctgcctggtcaaggactacttccctacagtgct

SEQ ID NO: 465892 - DNA, 492 bp, Homo sapiens
  misc_feature: HEFZJCU01CG8XQ.11.13.B02.1.454.heavy.3.raw
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggcgtgcctggtcaaggactacttccgtatctctcg

SEQ ID NO: 465893 - DNA, 516 bp, Homo sapiens
  misc_feature: HEFZJCU01DYIUU.48.78.H01.1.454.heavy.3.raw
agtatacatacacgaccggtgctcgatttagtgtgagtagtttgggtttggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagaaggggttttactagtggttcggggagtcgtccgaccagcaactggttccgaccccg

SEQ ID NO: 465894 - DNA, 379 bp, Homo sapiens; identical to SEQ ID NO: 444450
  misc_feature: HEFZJCU01EEWMU.47.77.G11.1.454.heavy.3.raw

SEQ ID NO: 465895 - DNA, 504 bp, Homo sapiens
  misc_feature: HEFZJCU01EC7DV.9.81.H04.1.454.heavy.3.raw
tgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttccttttgggtattttaaaaggtgtccagtgtgaagtgcagctggtggagtctgggggaggcttggtgcagcctggcacctccctgagactctcctgtgccgcctctggattcatgtttgatgattatgccatgcactgggtccggcaagttccagggaagggcctgggagtgggtctcaggtattacttggagtagcactaccacaggctatgcggactctgtgaggggccgattcaccatctccagagacaacgccaagaactccctatatctgcaaatgaatggtctgagagttgaggacacggccttgtattactgtgcaaaagataggaaacccgaggtggacgc

SEQ ID NO: 465896 - DNA, 480 bp, Homo sapiens
  misc_feature: HEFZJCU01BGU9K.11.63.F08.1.454.heavy.3.raw
cgagagataccacgaccggtgctcgatttagcgatcgtataagggggcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcactgggtgcgacaggcccctggacaagggcttgagtggatgggacggatcaaccctaatagtggtggcacaaactatgcacagaagtttgagggcagggtcatcatgaccagggacacggtccatcagcacagcctacatggagctgagcaggctgacatctgacgacacggccgtgtattactgtgcgagagataaaggggattgtgatagta

SEQ ID NO: 465897 - DNA, 525 bp, Homo sapiens
  misc_feature: HEFZJCU01DFBKY.49.27.C05.1.454.heavy.3.raw
agtcgagagacacgaccggtgctcgatttagacgcgatcgaagggtttgggggatttgggggcaatttatgaacccgaaaggacatggccatggggtgggtagggacagtagggacagatgtcagcctgaggtgaagcctcaggacacaggtgggcatggacagtgtccacctaagcgagggacagacccgagtgtccctgcagtagacctgagagcgctgggcccacagcctcccctcggggccctgctgcctcctcaggtcagccctggacatcccggctttccccaggcctggcggtaggtttgaagtgaggtctgtgtcactgtggtcttactatgatagtagtggttatattagcagccactcagcacattcggctactggggccagggaaccctggtcaccgtctcctcagcctccaccaagggcccatcggtcttccccctggcaccctcctccaagagcacctctgggggcacagcggccctgggctgcctggtcaaggactactcctctctcgact

SEQ ID NO: 465898 - DNA, 516 bp, Homo sapiens
  misc_feature: HEFZJCU01B4X05.46.67.G01.1.454.heavy.3.raw
actagcagtacacgaccggtgctcgatttagagtatacatattgggtttggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattcttatgggcgctcccactacagtgcggccctccagagtcgagccctcatatccatagacacgtccaagaccagtttccctgacgctgacgtctgtgaccgccgcagacacggctgtctattattgtgcgagactagccttctgtagtggggtacttgcaacccggggatactactccacctcggcttggacatcgtggggccggac

SEQ ID NO: 465899 - DNA, 514 bp, Homo sapiens
  misc_feature: HEFZJCU01EX84M.48.53.E09.1.454.heavy.3.raw
agtatacatacacgaccggtgctcgatttagagagagtgtgttgggtttggggatttagatgtctgtgttgggtttggggggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaaggcccatcggtcttcccctgcgccctgctccaggagcacctccgagagcacagcggccctgggctgcctggtcaaggactacttcctatgtata

SEQ ID NO: 465900 - DNA, 530 bp, Homo sapiens
  misc_feature: HEFZJCU01CJBRQ.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaccttcaacctgacgacactgccgtttattttgtacgagagcgtcgtctgtcagtggaattgactactggggccagggaaccctggtcaccgtctcctcagcctccaccaaggg

SEQ ID NO: 465901 - DNA, 418 bp, Homo sapiens
  misc_feature: HEFZJCU01DT73E.16.28.C06.1.454.heavy.3.raw
tgtactactccacgaccggtgctcgatttagagctcacgtattgggtttgggattgtctctggagtgggtctcacttattagtggtagtggtagtactacatactacgcagactccgtgaagggccggttcaccatctccagagacaatcccaagaacacgctgtatctgcaaatgaacggcttgagagccgaggacacggccgtatattactgtgcccgagggaggttttactatgatattactggttacaaaaaagggtactactttgactactggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 465902 - DNA, 528 bp, Homo sapiens
  misc_feature: HEFZJCU01DSY68.10.53.E09.1.454.heavy.3.raw
  modified_base (434)..(434): a, c, t, g, unknown or other
  modified_base (496)..(496): a, c, t, g, unknown or other
catagtagtgcacgaccggtgctcgatttagagagagtgtgttgggtttgggctgagcgtgggttttcctcgttagctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcgtcgggggaataccttcagcactggggccngggcaccctggtcaccgtctcctcagcctccaccaacgggcccatcggtcttcccctcggcnccctcctccaagagcacctctggggcacagcc

SEQ ID NO: 465903 - DNA, 513 bp, Homo sapiens; identical to SEQ ID NO: 446452
  misc_feature: HEFZJCU01BYGT8.17.33.C11.1.454.heavy.3.raw

SEQ ID NO: 465904 - DNA, 506 bp, Homo sapiens; identical to SEQ ID NO: 446520
  misc_feature: HEFZJCU01AOP7T.10.38.D05.1.454.heavy.3.raw

SEQ ID NO: 465905 - DNA, 518 bp, Homo sapiens; identical to SEQ ID NO: 444718
  misc_feature: HEFZJCU01DCTHP.9.34.D01.1.454.heavy.3.raw

SEQ ID NO: 465906 - DNA, 513 bp, Homo sapiens
  misc_feature: HEFZJCU01ELUDK.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccattcaccatctccagagacaattccaggaacacaatgtatttggaatgaacagcctaagtcctgaggacacgggtgtatactactgtacgaaggaggggggaaccgagcgggagttccaagtactctttgacgtctggggcc

SEQ ID NO: 465907 - DNA, 519 bp, Homo sapiens; identical to SEQ ID NO: 446650
  misc_feature: HEFZJCU01DQWAT.13.76.G10.1.454.heavy.3.raw

SEQ ID NO: 465908 - DNA, 515 bp, Homo sapiens
  misc_feature: HEFZJCU01CYYJT.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggttctacttcgatctc

SEQ ID NO: 465909 - DNA, 473 bp, Homo sapiens
  misc_feature: HEFZJCU01ARRUL.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctgggggccaagggacaatggtcaccgtctcttcagcctccaccaagggcccatcggtcttcccctggccgccctgctccaggagcacctccgagacgcacagcggccctgggctgcctggtcaaggactacttccctacagtgct

SEQ ID NO: 465910 - DNA, 483 bp, Homo sapiens
  misc_feature: HEFZJCU01DE5TQ.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaaggacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttccccctggcgccctgctccaggagcacctccgagagcacagcggccctgggctgcctggtcaaggactactcccactactatg

SEQ ID NO: 465911 - DNA, 535 bp, Homo sapiens
  misc_feature: HEFZJCU01DMHDV.48.56.F01.1.454.heavy.3.raw
agtatacatacacgaccggtgctcgatttagcagacgtctgaacacacaaagggggagagaagagcccagccctgggattttcaggtgttttcatttggtgatcaggactgaacagagagaactcaccatggagtttgggctgaggtggctttttcttgtggcgattttaagaggtgtccagtgtgaggtgaagttgttggagtctgggggaggcttggtaaagccggggggctccctgacactctcctgtgtaacctctggcttcgactttaagtcttatgccatgacctgggtccgccaggctccagggaaggggctggagtgggtctcaacaattagtgttagtggtgacgacagatactacgcagactccgtggagggccgcttcaccatctccagagacagccccaagaacacactgtctctggagatgatcaacctgagagccgacgacacggcagtgtattactgcgcgaaagaaatcaagtgggctcatctcgggcgccggacccactcggggccaggggtaacccg

SEQ ID NO: 465912 - DNA, 538 bp, Homo sapiens
  misc_feature: HEFZJCU01A6F7F.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccggggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtggtatttttgtgtgaaagatacgaagtctatgatacccaatttgggagggcctttcatgtctggggccaagggacgctggtcaccgtctcttcagcctccaccaagggcccatcggtcttcccctggcaccctcctccaagagcacctctgggggcacagcc

SEQ ID NO: 465913 - DNA, 516 bp, Homo sapiens
  misc_feature: HEFZJCU01A95FK.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaaggggacaatggtcaccgtctcttcagcctccaccaaggcccatcggtcttccccctggcaccctcctccaagagcacctctgggggcacagcggcccg

SEQ ID NO: 465914 - DNA, 504 bp, Homo sapiens
  misc_feature: HEFZJCU01BQL2T.10.28.C06.1.454.heavy.3.raw
catagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtggagtcggggggaggcttggtacagcctggggggtccctgagactctcctgtgtagcgtctggattcacattcagtagttatagcatgaactgggtccgccaggctccagggaaggggctggagtgggtttcatatattgatagaaatagtggaaccatatactatgcagactctgtgaggggccgattcaccatctccagagacaatgccaggaattcactgtatgtggaaatgaacagtctgagagccgagaacacggctctctattactgtgcgagagccccgaaaataggtactacg

SEQ ID NO: 465915 - DNA, 497 bp, Homo sapiens
  misc_feature: HEFZJCU01E08KQ.53.30.C08.1.454.heavy.3.raw
cgcgtatacacacgaccggtgctcgatttagtctgacgtcaaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacacgtccatcagcactgcctacatggagctgaccaggctgaaatttgaggacacggccatttattactgtgcaaggaacagcataatgactcgtccccggacttgta

SEQ ID NO: 465916 - DNA, 524 bp, Homo sapiens
  misc_feature: HEFZJCU01AHLT7.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggccatcggtcttcccctggcgccctgctccaggagcacctctgggggcacgagcggcccgtgggcctgcctgggtcaacgggactaaccgtttccccattacc

SEQ ID NO: 465917 - DNA, 479 bp, Homo sapiens; identical to SEQ ID NO: 447128
  misc_feature: HEFZJCU01DN62N.4.37.D04.1.454.heavy.3.raw

SEQ ID NO: 465918 - DNA, 465 bp, Homo sapiens; identical to SEQ ID NO: 447605
  misc_feature: HEFZJCU01EA0JL.9.34.D01.1.454.heavy.3.raw

SEQ ID NO: 465919 - DNA, 507 bp, Homo sapiens; identical to SEQ ID NO: 449199
  misc_feature: HEFZJCU01D9CPD.53.33.C11.1.454.heavy.3.raw

SEQ ID NO: 465920 - DNA, 383 bp, Homo sapiens; identical to SEQ ID NO: 454363
  misc_feature: HEFZJCU01CNAED.22.46.E02.1.454.heavy.3.raw

SEQ ID NO: 465921 - DNA, 519 bp, Homo sapiens; identical to SEQ ID NO: 445617
  misc_feature: HEFZJCU01BLFE3.9.34.D01.1.454.heavy.3.raw

SEQ ID NO: 465922 - DNA, 462 bp, Homo sapiens; identical to SEQ ID NO: 452067
  misc_feature: HEFZJCU01CEZU0.19.10.A10.1.454.heavy.3.raw

SEQ ID NO: 465923 - DNA, 518 bp, Homo sapiens
  misc_feature: HEFZJCU01A8M9C.53.38.D05.1.454.heavy.3.raw
cgcgtatacacacgaccggtgctcgatttagtatctgatagttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggttaccgttcgacccctggggccagggaaccctggtcaccgtcctcctcagcttccaccaacggcccactcggtcctttcccccgtcggccgtcccg

SEQ ID NO: 465924 - DNA, 504 bp, Homo sapiens
  misc_feature: HEFZJCU01ED5ON.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaaccaggtggtccttacaatgaccaaacatggaccctgtggacacagccacatattactgtgcacagagatacgggacaggcacgttgggtttgggggctacgtggggccagggaaccctggtcaccgtctcctcagcctccaaccg

SEQ ID NO: 465925 - DNA, 489 bp, Homo sapiens
  misc_feature: HEFZJCU01DKLD6.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagcggcctgggctgcctggtcaggactacttcccacgagagta

SEQ ID NO: 465926 - DNA, 506 bp, Homo sapiens; identical to SEQ ID NO: 448560
  misc_feature: HEFZJCU01CIHCK.17.25.C03.1.454.heavy.3.raw

SEQ ID NO: 465927 - DNA, 534 bp, Homo sapiens
  misc_feature: HEFZJCU01BF0EN.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtatggctgtgtttattggggccaggggagccctggtcacg

SEQ ID NO: 465928 - DNA, 511 bp, Homo sapiens
  misc_feature: HEFZJCU01B6O5Y.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccgttcaccatctccagagacaattccaagaacacactgtatctgcaaatgaacagcctgagagccgacgacacggccatatattactgtgcgaaagcaccggcagttagtcacccatactactttagactactggggaccg

SEQ ID NO: 465929 - DNA, 517 bp, Homo sapiens
  misc_feature: HEFZJCU01EDNGB.9.70.G04.1.454.heavy.3.raw
tgatacgtctcacgaccggtgctcgatttagtgtagtgtgaagggaaagggcctgtgaaggcttcactagtcctggacctcctatgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaactcctactacgtctggacgtctggggccagggaccgaac

SEQ ID NO: 465930 - DNA, 518 bp, Homo sapiens
  misc_feature: HEFZJCU01DGYQN.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgctttgatatctggggccaagggacaatggtcaccgtctcttctagcctccaccaagggcccatcggtcttcccctggccaccctcctccaacgagcacctctggggggcacagcggtccc

SEQ ID NO: 465931 - DNA, 501 bp, Homo sapiens
  misc_feature: HEFZJCU01EVOS2.14.23.C01.1.454.heavy.3.raw
cgtctagtaccacgaccggtgctcgatttagtacacgtgattagggattggggccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcactttcagcacctatgctatcaactgggtgcgacaggcccctggacaagggcttgagtggatgggaggaatcatccctatgtttggtacaactaactacacacagaagttccagggcagagtcacgattaccgcggacgaatccacgagcacagcctacatggagctgagcagcctgagatctgacgacacggccgtgtattactgtgcgagggcctcggttcttcagtgcctggttgagaacgtgggcgagggaactctggtcaccgtctcctcacgcctccaccg

SEQ ID NO: 465932 - DNA, 519 bp, Homo sapiens
  misc_feature: HEFZJCU01CG2QN.13.76.G10.1.454.heavy.3.raw
tcacgtactacacgaccggtgctcgatttagtcactcatacaggggagaggagcccagcactgggattccgaggtgtttccattcggtgatcagcactgaacacagaggactcaccatggagttttggctgagctgggttttccttgttgctatttttaaaaggtgcccagtgtgaggtgcagctggtggagtctggaggaggctttatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtcgtggggccaagggaccac

SEQ ID NO: 465933 - DNA, 498 bp, Homo sapiens
  misc_feature: HEFZJCU01DZT6J.12.2.A02.1.454.heavy.3.raw
atacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgagtggatgggatggatcagcgcttacaatggtaacacagactatgcacagaagttccaggacagagtcaccatgaccacagacacatccacgagcacagcctacatggagctgaggagcctgagatctgacgacacggccgtgtattactgtgcgagaggttttagtgatacttattgtagtggtggtacctgtactactttttc

SEQ ID NO: 465934 - DNA, 519 bp, Homo sapiens; identical to SEQ ID NO: 446650
  misc_feature: HEFZJCU01B9VP7.13.76.G10.1.454.heavy.3.raw

SEQ ID NO: 465935 - DNA, 504 bp, Homo sapiens
  misc_feature: HEFZJCU01B9IJT.3.23.C01.1.454.heavy.3.raw
agacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaaatgaacagcctggagacgcggacacagccatgtattattgtacattaggacactatagtccctggggccagggaaccctcgtcaccgtctcctcagcctccaccaaggcccatcggtcttcccctggcg

SEQ ID NO: 465936 - DNA, 534 bp, Homo sapiens
  misc_feature: HEFZJCU01D50HE.52.73.G07.1.454.heavy.3.raw
cgcagtacgacacgaccggtgctcgatttagctctacgctcagggggctttccgagagtcatggacctcctgcacaagaacatgaaacacctgtggttcttcctcctcctggtggcagctcccagatgggtcctgtcccaggtgcacctacaacagtggggcgcaggactgttgaagccttcggagaccctgtccctcacctgcgctgtcgatggtgggtccttcagtggtcgctactggacctggatccgccagcccccagggaaggggctggagtggattggggaaatcaatcatactggaagcattaactataacccgtcccttaagagtcgagtcaccatatcagtcgacacgtccaagaaccaattctccctgaaggtgaggtctgttaccgccgcggacacggctgtctattactgtgcgaaaggccctcacgatgaaaactacgcccctggcgctatggacgtctggggccaagggaccacggtcaccgtctcctcagcctccaccaaggcccatcggtcttcccct

SEQ ID NO: 465937 - DNA, 540 bp, Homo sapiens
  misc_feature: HEFZJCU01CNFZ5.14.57.F02.1.454.heavy.3.raw
  modified_base (432)..(432): a, c, t, g, unknown or other
  modified_base (488)..(488): a, c, t, g, unknown or other
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaaagacgaagacacgggcgtgtatttttgtgtgaaagatacgaagtctatgatacccaatttgggaggggcctttnatgtctgggccaagggacgctggtcaccgtctcttcagcctccacccaaggcccancggtcttcccctggcaccctcctccaacgagcacctctgggggtcacgagcc

SEQ ID NO: 465938 - DNA, 527 bp, Homo sapiens
  misc_feature: HEFZJCU01BDWC9.12.40.D07.1.454.heavy.3.raw
atacgacgtacacgaccggtgctcgatttagtgatagagcgtaacaacagagggctcaccatggagtttgggctgagcgtgggttttcctcgttagctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtctcccctggcgcctcg

SEQ ID NO: 465939 - DNA, 525 bp, Homo sapiens
  misc_feature: HEFZJCU01AI62F.17.34.D01.1.454.heavy.3.raw
cgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactatacactgctcttttacacctcccttgacttctggggccatggacccggtcaccgt

SEQ ID NO: 465940 - DNA, 509 bp, Homo sapiens
  misc_feature: HEFZJCU01D6RWI.48.81.H04.1.454.heavy.3.raw
agtatacatacacgaccggtgctcgatttagtagtgtagattcgcgggggcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaattcacgggcacagcgcagttggacctgagcggcctgagaccgtgaggacaacggccatttactactgtgcgcggggaggtggacggagctcggttttcgagttatcatctactactttgaa

SEQ ID NO: 465941 - DNA, 412 bp, Homo sapiens
  misc_feature: HEFZJCU01B3DHX.40.81.H04.1.454.heavy.3.raw
tctagcgactcacgaccggtgctcgatttagtagtgtagattcgcgggggcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggat

SEQ ID NO: 465942 - DNA, 523 bp, Homo sapiens
  misc_feature: HEFZJCU01D62ED.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaaggcccatcggtcttcccctggcgccctgctccaggagcacctccgagagcacagcggccctgggctgcctggtcaaggactacttcc

SEQ ID NO: 465943 - DNA, 499 bp, Homo sapiens; identical to SEQ ID NO: 458927
  misc_feature: HEFZJCU01EI744.5.41.D08.1.454.heavy.3.raw

SEQ ID NO: 465944 - DNA, 509 bp, Homo sapiens
  misc_feature: HEFZJCU01DDOZ4.16.15.B04.1.454.heavy.3.raw
tgtactactccacgaccggtgctcgatttagacagtatatatccgcggggagctctgagagaggagcccagccctgggattttcaggtgttttcatttggtgatcagggctgaacagagagaactcaccatggagtttgggctgagctggctttttcttgtggctattttaaaaggtgtccagtgtgaggtgcagctgttggagtctgggggaggcttggtacagcctggggggtccctgagactctcctgtgcagcctctggattcatctttagcagctatgtcatgacctgggtccgccaggctccagggaagggctggagtgggtctcagttattggtggtagtggttataccacatactacgcagactccgtgaagggccggttcaccatctccagagacaattccaagaacacactatatctgcaaatgaacagcctgagagccgaggacacggccgtatattactgtgcgaaaggccagggtatagcagtggctggtaccaac

SEQ ID NO: 465945 - DNA, 489 bp, Homo sapiens; identical to SEQ ID NO: 444591
  misc_feature: HEFZJCU01CXB9V.18.70.G04.1.454.heavy.3.raw

SEQ ID NO: 465946 - DNA, 496 bp, Homo sapiens; identical to SEQ ID NO: 444697
  misc_feature: HEFZJCU01AE49Z.16.37.D04.1.454.heavy.3.raw

SEQ ID NO: 465947 - DNA, 504 bp, Homo sapiens
  misc_feature: HEFZJCU01B8HQC.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggaccacccccacgaacacagtctacatgcaactgacgagcctgagagctgacgacacgggccgtctattactgtgcgagaatgttttctgtcatcgtacaatttgataggctctatggactggacttcgtc

SEQ ID NO: 465948 - DNA, 505 bp, Homo sapiens
  misc_feature: HEFZJCU01B3D4E.48.9.A09.1.454.heavy.3.raw
agtatacatacacgaccggtgctcgatttagcgagacgcgcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgaggcgcagtggtctttttgatgcctttgatagtgtgggggccaagggacaagtggtcaccgtctt

SEQ ID NO: 465949 - DNA, 500 bp, Homo sapiens
  misc_feature: HEFZJCU01B0SME.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaaccaggtggtccttacaatgaccaacatggaccctgtggacacagccacatattactgtgcacagagatacgggcagcacgtggtttgggggctacgtcgggccagggaaccctggtcaccgtctcctcagccctccaaccg

SEQ ID NO: 465950 - DNA, 515 bp, Homo sapiens
  misc_feature: HEFZJCU01DG1IM.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcggacggcttatctgcagataaccaaccttcaacctgacgacactgccgtttatttttgtacgagagcgtcgtctgtcagtggaattgactactgggccagggaaccctggtcaccgtctcctcagcctccaccaaggccatcggtcttcccctggccaccctcctccaagagcacctctggggcacagcggccctgggctgcctggtcaaggactacttcctagagacacg

SEQ ID NO: 465951 - DNA, 525 bp, Homo sapiens
  misc_feature: HEFZJCU01DTRQW.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatgacgtctggggccaagggactac

SEQ ID NO: 465952 - DNA, 511 bp, Homo sapiens
  misc_feature: HEFZJCU01AEH4A.48.34.D01.1.454.heavy.3.raw
agtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaggcccatcggtcttcccctggcgccctgctccaggagcacctccgagacgcacagcggcccgtgggctgcctggtcaaggactactt

SEQ ID NO: 465953 - DNA, 494 bp, Homo sapiens
  misc_feature: HEFZJCU01EHEPE.53.87.H10.1.454.heavy.3.raw
cgcgtatacacacgaccggtgctcgatttagcagtactgcgttgggtttgggggagcatcaccctgcaaccacagctgtcctctagagaacccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcagggcagggtctccatgaccagggacagggccatcagaacagcctacatggagctgaacagactgacatctgacgacacggccgttttattattgtgtgagagaggacccgatcgacctc

SEQ ID NO: 465954 - DNA, 525 bp, Homo sapiens; identical to SEQ ID NO: 450535
  misc_feature: HEFZJCU01DJPY6.18.33.C11.1.454.heavy.3.raw

SEQ ID NO: 465955 - DNA, 547 bp, Homo sapiens
  misc_feature: HEFZJCU01AV2N2.13.40.D07.1.454.heavy.3.raw
  modified_base (508)..(508): a, c, t, g, unknown or other
tcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccaggggggggcctggagtggcttggaagcatctctcaaagcgggacgaccgactataacccgtcttttaggagtcgagtctcgatttcaatagacaggtctaagacacaattctccctgagggtgacctctatgtcggccgcggacgcggccgtctattactgtgcgcgaggatctccgtcggaacacttcgtgacaaggcaaaacgtccgaagtcgttatcactttgactcctgggccagggaaccctggtcagcgtcgtcttcagcctccaccaacgggcccatcggtccttccccctggccaccctcctccaagngccacctcctgggggcacagcggccctcggggcctgccc

SEQ ID NO: 465956 - DNA, 507 bp, Homo sapiens; identical to SEQ ID NO: 457752
  misc_feature: HEFZJCU01BZ0M4.16.71.G05.1.454.heavy.3.raw

SEQ ID NO: 465957 - DNA, 535 bp, Homo sapiens
  misc_feature: HEFZJCU01ESM5O.11.10.A10.1.454.heavy.3.raw
cgagagataccacgaccggtgctcgatttagcgtcgatctcaggggctgtcgtgatgattgcgtggtgggactctgtcccgctccaaggcacccgctctctgggacgggtgccccccggggtttttggactcctgggggtgacttagcagccgtctgcttgcagttggacttcccaggccgacagtggtctggcttctgaggggtcaggccagaatgtggggtacgtgggaggccagcagagggttccatgagaagggcaggacagggccacggacagtcagcttccatgtgacgcccggagacagaaggtctctgggtggctgggtttttgtggggtgaggatggacattctgccattgtgattactactactactactacatggacgtctggggcaaagggaccacggtcaccgtctcctcagcctccaccaagggcccatcggtcttcccctggcaccctcctccaagagcacctctgggggcacagcggccctgggctgcctggtcaggactacttccgtatctctcgtcg

SEQ ID NO: 465958 - DNA, 520 bp, Homo sapiens
  misc_feature: HEFZJCU01DWQ2F.4.33.C11.1.454.heavy.3.raw
agcactgtagcacgaccggtgctcgatttagagtgagctcgttgggtttgggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatgaacagcctgaagaccgaggacacagccgtctattactgtgttagggtagttttacgtatttttggaggtggagtatttactaacccctac

SEQ ID NO: 465959 - DNA, 514 bp, Homo sapiens
  misc_feature: HEFZJCU01EUS5P.51.21.B10.1.454.heavy.3.raw
cgatcgtatacacgaccggtgctcgatttagtgtcgtcgcaagggggggcatcatccaacaaccacatcccttctctacagaagcctctgagaggaaagttcttcaccatggactggacctggagggtcttctgcttgctggctgtagctccaggtgctcactccctggtgcagctggtgcagtctggggctgaggtgaagaagcctggggcctcagtgacgatttcctgtaggacatctggatacacgttcaccggctattttatgtactgggtgcgacaggcccctggacaaggccttgagtggatgggaaagatcaaccctagtggtggtaccacaagttacgcccagaaattccagggcagagtctccatgaccagaaatacgtccgcgaggacagtctacatggagttgagcagcctgagaactgacgacacggccatatattactgtgcgagagaccttgctggtccttttgtacttctcggggccagggaaccctcggtcaccgtcc

SEQ ID NO: 465960 - DNA, 517 bp, Homo sapiens
  misc_feature: HEFZJCU01EDNZ1.22.28.C06.1.454.heavy.3.raw
acatacgcgtcacgaccggtgctcgatttagagctcacgtattgggtttggggaagtagtccttgaccaggcagctcccagatgggtcctgtcccaggtgcacctgcaggagtcgggcccaggactggtgaagccttcggagaccctgtccctcacctgcattgtctccggtggctccatcagtgattactactggacctggatccggcagtccccagggcagggactggaatggattggatatttccatacgactgcgatgaccaactgcaacccctccctcagggctcgagtcagcctgtcagtagacacgtccaagaaccagacttccctgagactgacctctgtgaccgccgcagacacggccgtgtatttctgtgtcggtacgagtgtccatgacagtcacaaacaactggtctcctggggccagggaaccctggtcaccgtctcctcagcctccaccaagggcccatcggtcttcccctggcaccctcctccaagacgcacctctgggggc

SEQ ID NO: 465961 - DNA, 501 bp, Homo sapiens; identical to SEQ ID NO: 447719
  misc_feature: HEFZJCU01EDN1W.17.10.A10.1.454.heavy.3.raw

SEQ ID NO: 465962 - DNA, 503 bp, Homo sapiens
  misc_feature: HEFZJCU01CV4X8.51.81.H04.1.454.heavy.3.raw
cgatcgtatacacgaccggtgctcgatttagtagtgtagattcgcgggggctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgtttacttgtgcgagagggaactcgattacagcagccctcg

SEQ ID NO: 465963 - DNA, 524 bp, Homo sapiens
  misc_feature: HEFZJCU01BLPQ9.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggatacagtggcagctccaagtactactttgacttctggggccagggaaccctggtcaccgtctcctcagcctccaccaagggcccatcggtcttcccctggcgccctgctccaggagcacctccgag

SEQ ID NO: 465964 - DNA, 531 bp, Homo sapiens
  misc_feature: HEFZJCU01CG4FW.12.40.D07.1.454.heavy.3.raw
  modified_base (464)..(464): a, c, t, g, unknown or other
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacgggctgtctattattgcgcgagagagacacacgaacctaactggccaatactatgggggcttgttctggggaccnggggacccgtggtcatcgtctccccagcctccaccacggaccactcggtcttcccctcgtccgccgt

SEQ ID NO: 465965 - DNA, 396 bp, Homo sapiens; identical to SEQ ID NO: 444426
  misc_feature: HEFZJCU01DQHLW.18.31.C09.1.454.heavy.3.raw

SEQ ID NO: 465966 - DNA, 500 bp, Homo sapiens
  misc_feature: HEFZJCU01BQP3X.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgtctttgatatctggggccaagggac

SEQ ID NO: 465967 - DNA, 507 bp, Homo sapiens
  misc_feature: HEFZJCU01BXB86.52.82.H05.1.454.heavy.3.raw
cgcagtacgacacgaccggtgctcgatttagtcgagctctctcgcgggggggagacgagcccagcactggaagtcgccggtgtttccattcggtgatcatcactgaacacagaggactcaccatggagtttgggctgagctgggttttcctcgttgctcttttaagaggtgtccagtgtcaggtacaactggtggagtctgggggaggcgtggtccagcctgggaggtccctgagactctcctgtgcagcctctggattcaccttcagtacctatagtatacactgggtccgccaggctcctggcaagggactggagtgggtggcatctatatcaaatgatggaaacaataaccattctacagactccgtaaagggccgattcaccatctccagagacaattccaagaacacggtgtctctacaaatgaacagtttgagacttgaggacacggctgtatattactgtgcgcgagggaattcgattatagcagccctcgaagaccatc

SEQ ID NO: 465968 - DNA, 505 bp, Homo sapiens
  misc_feature: HEFZJCU01BAH24.53.78.H01.1.454.heavy.3.raw
cgcgtatacacacgaccggtgctcgatttagtgtgagtagtttgggtttgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgacccctggggccagggaaccctggtcaccgtctcctcagcttccaccaagggcccatcggtcttcccctggcgcctgctccaggagcacctctgggggcgacagcggccctgggctgcctggtcaaggactacttcctcgtac

SEQ ID NO: 465969 - DNA, 507 bp, Homo sapiens
  misc_feature: HEFZJCU01DSQ3W.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcaccatcctccgggacagacttaccatgaccacgaactcctccataaacacagcctacatggagttgaggagcctgacatctgacgacacggccgtctattactgtgcgagagtccccagatccgggtgagccctacggcaggcggccctttgactttctc

SEQ ID NO: 465970 - DNA, 499 bp, Homo sapiens
  misc_feature: HEFZJCU01DYFMI.40.31.C09.1.454.heavy.3.raw
tctagcgactcacgaccggtgctcgatttagacgtctcatcaaggaaggaagggggcttttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggcccgagcgcagtggtcttttgatgcttgatatgtgggcaggacaagtgtcaccg

SEQ ID NO: 465971 - DNA, 324 bp, Homo sapiens; identical to SEQ ID NO: 444475
  misc_feature: HEFZJCU01DOHR3.18.17.B06.1.454.heavy.3.raw

SEQ ID NO: 465972 - DNA, 403 bp, Homo sapiens; identical to SEQ ID NO: 445029
  misc_feature: HEFZJCU01D4BTX.10.77.G11.1.454.heavy.3.raw

SEQ ID NO: 465973 - DNA, 518 bp, Homo sapiens
  misc_feature: HEFZJCU01EU28B.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtgcagttgttcatctgagggcagtgttcaatggtatgctgacgcgtgaagggccgattcaccatctccagagacaactccaggaacacaatgtatttggacctgaacagctaagtcctgaggacacgggtgtatactactgtacgaaggaggggggaaccagcgggagttccaagtactctttgacgtctc

SEQ ID NO: 465974 - DNA, 501 bp, Homo sapiens; identical to SEQ ID NO: 447719
  misc_feature: HEFZJCU01ETQ7C.17.10.A10.1.454.heavy.3.raw

SEQ ID NO: 465975 - DNA, 482 bp, Homo sapiens; identical to SEQ ID NO: 444503
  misc_feature: HEFZJCU01DPH62.7.10.A10.1.454.heavy.3.raw

SEQ ID NO: 465976 - DNA, 520 bp, Homo sapiens; identical to SEQ ID NO: 450321
  misc_feature: HEFZJCU01C8MMT.9.34.D01.1.454.heavy.3.raw

SEQ ID NO: 465977 - DNA, 525 bp, Homo sapiens
  misc_feature: HEFZJCU01DZB9K.47.6.A06.1.454.heavy.3.raw
agctcacgtacacgaccggtgctcgatttagatctactgacagcacacaagggggggaaatactttctgagagtcctggacctcctgtgcaagaacatgaaacatctgtggttcttccttctcctggtggcagctcccacatgggtcctgtcccaggtgcagctgcaggagtcgggcccaggactggtgaagccttcggagaccctgtccctcacttgcactgtctctggtggctccatcaggagttactactggacctggcttcggcagtccccagggaagggactggagtggattgggtataattattacagtgggaccaccaactacaacccctccctcaagagtcgagtcaccatatcaatagacacgtcgaagaaccagttctccctgaagttgaactcagtgaccgctgcggacacggccgtgtattactgtgcgagccacaccgattacgatttttggagtggccttgataactggggccgaggggatcctggtcaccgtctcctcagcctccaccac

SEQ ID NO: 465978 - DNA, 507 bp, Homo sapiens
  misc_feature: HEFZJCU01AV7CS.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactgggccagggaactctggtcaccgtctcgcagcctccacaggcc

SEQ ID NO: 465979 - DNA, 518 bp, Homo sapiens
  misc_feature: HEFZJCU01E2AU5.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgtgaaggaggcatatgggaagtacgattttcgatccctccgcagtcgacactttgattactgggccggggaaccctggtcgccgtctcctcagcctccaccaagggcccatcggtcttccccctggcaccctcctccaagagcacctctgggggcacagcggccctgggctgcctggtcaaggactacttccagacgtatca

SEQ ID NO: 465980 - DNA, 480 bp, Homo sapiens
  misc_feature: HEFZJCU01EL2H5.49.8.A08.1.454.heavy.3.raw
  modified_base (429)..(429): a, c, t, g, unknown or other
agtcgagagacacgaccggtgctcgatttagcatactctacaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtgcagttatatcatatgatggaagcaatatatactatgtagactccgtgaagggccgattcatcatctccagagacaattccgagaacacgctgtatctgcaaatgaanagcctgagagctgaggacacggctgtgtatactgtgcgaactttaatcaac

SEQ ID NO: 465981 - DNA, 514 bp, Homo sapiens
  misc_feature: HEFZJCU01DBLQH.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacgggtcatcgtctccgcagcctccaccaagggcccatcggtcttccccctggcaccctcctccaagagcacctctgggggcacagcggccctgggctgcctggtcaaggactacttccgagtgtgtct

SEQ ID NO: 465982 - DNA, 519 bp, Homo sapiens
  misc_feature: HEFZJCU01DF451.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtggcgttttcttaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaaggggccggttcaccatctccagagacaattccaagaacacactgtatctgcaaatgaacagcctgagagccggacgaacacggccatatattactgtgcgaaaagcaccggcaggttatcacccaatactactttcgactactgggggcc

SEQ ID NO: 465983 - DNA, 517 bp, Homo sapiens
  misc_feature: HEFZJCU01EHT8E.51.77.G11.1.454.heavy.3.raw
cgatcgtatacacgaccggtgctcgatttagctagtcactcaagggaaaggggcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatttcatatgatggaagtaaaatattctatgtagactccgtgaagggccgcttcatcatctccagagacaattcccagaacaccctgtttctgcaaatgcacagcctgagacctgaggacacggctgtgtattactgtgcgaacttaatcacggaggacaacggtgacccccgtccgctcggtgcggaggtctggggccaagggaccacggtcatcgtctcctcagcctccaccaagggcccatcggtccttcccctggccaccctcctccaagagcacctcgtggggcacagcggccctggctgcctggtcaaggacta

SEQ ID NO: 465984 - DNA, 549 bp, Homo sapiens
  misc_feature: HEFZJCU01ASWEV.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctcgatagcaggtggctggtcccacgttaggttttgacttacgtgggggcccaagggggaacgcgtttgggtccacccggttcctccctcacggccctacccg

SEQ ID NO: 465985 - DNA, 376 bp, Homo sapiens
  misc_feature: HEFZJCU01CA91R.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccgggaaccctggtcaccgtctcttcagcttccaccaagggcccatcgtcttcccctggcgtcctgctccaggagcacctctgggggcacagcggccctgggctgcctggtcaaggactacttcctacgtgagct

SEQ ID NO: 465986 - DNA, 387 bp, Homo sapiens
  misc_feature: HEFZJCU01DJVND.11.20.B09.1.454.heavy.3.raw
cgagagataccacgaccggtgctcgatttagtgtagtgtgaaggggtacgtgccaagcatcctcgtgcgaccgcgagagcccggggagcgggggcttgccggccgattcaccatctcccgagacgattccaacaatatgttctatctgcaaatgagccgcctgagaagcaaggacacggctgtctattactgtgcgagagacggatttctgcactctacctactacttcttctacatggacgtctggggcagagggacaacggtcaccgtctccttagcctccaccaagggcccatcggtcttccccctggcaccctcctccaagagcacctctgggggcacagtggccctgggctgcctggtcaaggactacttccgtatctctcg

SEQ ID NO: 465987 - DNA, 507 bp, Homo sapiens; identical to SEQ ID NO: 460264
  misc_feature: HEFZJCU01CL6QN.18.50.E06.1.454.heavy.3.raw

SEQ ID NO: 465988 - DNA, 542 bp, Homo sapiens
  misc_feature: HEFZJCU01AXZXY.18.59.F04.1.454.heavy.3.raw
tacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcaacgctgtatctgcaaatgaacagcctgagaaccgaggacacagccgtgtattactgtaccacatcccctgaaagcgtcaactactactactacggtatggacctctggggccaagggaccg

SEQ ID NO: 465989 - DNA, 446 bp, Homo sapiens
  misc_feature: HEFZJCU01AHEN3.51.25.C03.1.454.heavy.3.raw
cgatcgtatacacgaccggtgctcgatttagtagtgtagatttgggtttgggtagttgggtttggggggaagaggaagactgacggtccccccaggagttcaggtgctggactgggtggcaggcatatcatttgatggaagcaagaagtactatgcagactccgtgaagggccgattcaccatctccagagacagttccgatgacacagtctatctacacatgagcagtgtgagacctgacgacacggctctttttactgtgcgccaggaagcagtggctggccacatcatgcttttgatatctggagccaagggacaatggtcatcgtctcttcggcctccaccaagggcccatcggtcttccccctggcaccctcctccaagagcacctctgggggcacagcggccctgggctgcctggtcaaggactacttcctcgtagcact

SEQ ID NO: 465990 - DNA, 531 bp, Homo sapiens
  misc_feature: HEFZJCU01B92RN.14.57.F02.1.454.heavy.3.raw
cgtctagtaccacgaccggtgctcgatttagctcgatatagttgggtttgggtgcccaagctgctggagggcacggtcaccacgctgctgagggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaagggcccatcggtcttcccctggcaccctcctccaagagcacctctgggggcacagcggccctgggctgcctggtcaggta

SEQ ID NO: 465991 - DNA, 394 bp, Homo sapiens
  misc_feature: HEFZJCU01DTB01.16.24.C02.1.454.heavy.3.raw
tgtactactccacgaccggtgctcgatttagtacagatcgttagggaaggggctggagtgggtctcaaagtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 465992 - DNA, 495 bp, Homo sapiens
  misc_feature: HEFZJCU01CJJYJ.52.78.H01.1.454.heavy.3.raw
cgcagtacgacacgaccggtgctcgatttagtgtgagtagtttgggtttgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttctggggccagggaacccgggtcaccgtctcctcagcctccaccaagggcccatcggtcttccccctggcaccctcctccaagagcacctctgggggcacagcggccctgggctgcctggtcaaggactacttcctatacgatcg

SEQ ID NO: 465993 - DNA, 482 bp, Homo sapiens
  misc_feature: HEFZJCU01EAQMA.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacgggtcatcgtctcctcagcctcaccaagggcccatcggtctcccctggcaccctcctccaagagcacctctgggggcacagcggccctgggctgcctggtcaaggactacttccgtatctctcg

SEQ ID NO: 465994 - DNA, 508 bp, Homo sapiens; identical to SEQ ID NO: 445594
  misc_feature: HEFZJCU01DLJOR.17.25.C03.1.454.heavy.3.raw

SEQ ID NO: 465995 - DNA, 496 bp, Homo sapiens
  misc_feature: HEFZJCU01AC4PZ.10.71.G05.1.454.heavy.3.raw
catagtagtgcacgaccggtgctcgatttagtgtcgtcgcaagagagaggggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatcctagtggcatcacctggta

SEQ ID NO: 465996 - DNA, 490 bp, Homo sapiens; identical to SEQ ID NO: 444500
  misc_feature: HEFZJCU01B4HL3.19.53.E09.1.454.heavy.3.raw

SEQ ID NO: 465997 - DNA, 501 bp, Homo sapiens; identical to SEQ ID NO: 447719
  misc_feature: HEFZJCU01EKB45.17.10.A10.1.454.heavy.3.raw

SEQ ID NO: 465998 - DNA, 502 bp, Homo sapiens
  misc_feature: HEFZJCU01ECP6K.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtcgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaatttgataggctctatggactggacttcgc

SEQ ID NO: 465999 - DNA, 505 bp, Homo sapiens
  misc_feature: HEFZJCU01D2JES.48.9.A09.1.454.heavy.3.raw
agtatacatacacgaccggtgctcgatttagcgagacgcgcagggggctttctgagagtcatggatcacatgtgcaagaaaatgaagcacctgtggttcttcctcctgctggtggcggctcccagatgggtcctgtcccaggtgcagctgcaggagtcgggcccaggactggtgaagccttcggagaccctgtccctcacgtgcactgtctctggtgactccatcaacaatagtcattactactggggctggatccgccagtccccagggaaggggctggagtggattggaattatctattatagcgggagcacctactataatccgtccctcaagagtcgagtcaccatatccgtagacacatccaagaaccagttctccctgaggctgagccctgtgaccgccgcagacacggctgtctattactgtcgcgacccatcgatatcatgactggttgttagggcacggtctggggccaaggggaccacggtccaccgtctcctcg

SEQ ID NO: 466000 - DNA, 483 bp, Homo sapiens; identical to SEQ ID NO: 449188
  misc_feature: HEFZJCU01D5ZOC.7.10.A10.1.454.heavy.3.raw

SEQ ID NO: 466001 - DNA, 492 bp, Homo sapiens
  misc_feature: HEFZJCU01CWHM3.40.81.H04.1.454.heavy.3.raw
  modified_base (388)..(388): a, c, t, g, unknown or other
  modified_base (462)..(462): a, c, t, g, unknown or other
  modified_base (470)..(470): a, c, t, g, unknown or other
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacncgtcatcagcacagtctacatggatctgagcggactgacctctgacgacacggccatgtattactgtggaaganacgttggnggctaaccggcgggcgtgacca

SEQ ID NO: 466002 - DNA, 527 bp, Homo sapiens
  misc_feature: HEFZJCU01BEE6N.22.85.H08.1.454.heavy.3.raw
acatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctgggagtggatctcacttatttatagtggtggtaccacatactacacagactccgtgaagggccgattcaccatctcagaagacaattcccaggaacacattgtatcttcaaatgaataacctgagagccgaggacacggccatgtattactgtgtggggcatttacttgacccctggggccggggaaccctggtcaccgtctccccaccctccaccg

SEQ ID NO: 466003 - DNA, 545 bp, Homo sapiens
  misc_feature: HEFZJCU01DO2CK.10.53.E09.1.454.heavy.3.raw
catagtagtgcacgaccggtgctcgatttagagagagtgtgttgggtttgggctgagctgggttttcctcgttgctcttttaagaggtgtccagtgtcaggtgcagctggtggagtctggggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcgtcgggggaataccttcagcactggggccgagggcaccctggtcaccgtctcctcacgcctccaccaacgggcccatccggtctttccccctcggcacccctccttcccaacgaacgcaccctcctcggggggcacgagccc

SEQ ID NO: 466004 - DNA, 527 bp, Homo sapiens
  misc_feature: HEFZJCU01DJUIK.12.86.H09.1.454.heavy.3.raw
  modified_base (380)..(380): a, c, t, g, unknown or other
  modified_base (494)..(494): a, c, t, g, unknown or other
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttcngtgcgagtcttgatagtagtggttatcctgaatactggggccagggaaccctggtgaccgtctcctcagcctcaccaaggcccatcggtcttcccctggcgcctgctccaggancgacctccgagacgcacagccggccctgggtcg

SEQ ID NO: 466005 - DNA, 527 bp, Homo sapiens
  misc_feature: HEFZJCU01DMUBI.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagccctgagaccagacgacacggctgtctattattgcgcgagagagacacacgaacctactggccaatactatgggggcttgttctggggccaggggacctggtcatcgtctccccagcctccaccaaggcccatcggtcttccccctggccgcctcg

SEQ ID NO: 466006 - DNA, 500 bp, Homo sapiens
  misc_feature: HEFZJCU01DDNEG.13.12.B01.1.454.heavy.3.raw
tcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaagggccgattcgccatctccagagacaattccaggaacacgctgtacctggagatggacggcctgagacctgacgacacggcaatttattactgtgcgagggtttatgtgttggaacgtggtacaccggaaaactggttcgacccctggggccagggaaccctggtcgtcgtctcgtctgcctccaccaagggcccatcggtcttccccctggcgccctgctccaggagcacctccgagagcacagcggccctgggctgcctggtcaggactacttcctagtacgtga

SEQ ID NO: 466007 - DNA, 492 bp, Homo sapiens; identical to SEQ ID NO: 444695
  misc_feature: HEFZJCU01BWFPG.3.34.D01.1.454.heavy.3.raw

SEQ ID NO: 466008 - DNA, 509 bp, Homo sapiens
  misc_feature: HEFZJCU01B24VO.3.71.G05.1.454.heavy.3.raw
agacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggattttccttttggctattttaaaaggtgtccggtgtgaagtgcaactggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtgataacatcggctatgcggactctgtgaagggccgattcaccatctccagagacaacgccaagaactccctgtatctgcaaatgaacagtctgagacctgaggacacggccttgtattactgtgtaaagtcccggggaaatatgtacgattttt

SEQ ID NO: 466009 - DNA, 513 bp, Homo sapiens
  misc_feature: HEFZJCU01CLSZK.19.26.C04.1.454.heavy.3.raw
tactctcgtgcacgaccggtgctcgatttagtctagcgactttgggtttgggctgagcgtgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctggggccaagggaccacggtcatcgtctccccagcctccaccaagggcccatcggtcttccccctggccgccctgctccaggagc

SEQ ID NO: 466010 - DNA, 510 bp, Homo sapiens
  misc_feature: HEFZJCU01AHPFF.48.34.D01.1.454.heavy.3.raw
agtatacatacacgaccggtgctcgatttagatcgtctgtgttgggtttggggtctgggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggt

SEQ ID NO: 466011 - DNA, 495 bp, Homo sapiens
  misc_feature: HEFZJCU01DPAJG.52.19.B08.1.454.heavy.3.raw
cgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggtttcctcgttgctcttttaagaggtgtccagtgtcaggtgcaactggtggagtctgggggaggcgtggtccagcctgggaggtccctgagactctcttgtgctgcctctggattcaccttcagggtctatgacatgcactgggtccgccaggctccaggcaaggggctggagtgggtggcatttatatcatatgatggaagcaagatatactatgtagactccgtagaagggccgattcatcatctccagagacaactccgaagaacacgctgtatctgcaaatgatcaggctggagagctagaagacacggtctttatattactgtgcgtaactttaatcgaacgggaac

SEQ ID NO: 466012 - DNA, 518 bp, Homo sapiens
  misc_feature: HEFZJCU01AI2NB.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaaggaggggggaaccgaggcgggagttccgaagtactcctttgtacg

SEQ ID NO: 466013 - DNA, 507 bp, Homo sapiens
  misc_feature: HEFZJCU01EAX2Y.4.57.F02.1.454.heavy.3.raw
agcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtcttttgaccagtggggccagggaaccctggtcaccgtctcctcagcttccaccaagggcccatcggtcttcccctggcgccctgctccaggagcacctctcggggc

SEQ ID NO: 466014 - DNA, 512 bp, Homo sapiens
  misc_feature: HEFZJCU01ET32Z.51.40.D07.1.454.heavy.3.raw
cgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtctgggggaggcgtggtccagcctgggaggtccctgagactctcctgtgtagtctctggattcaccttcagggtgtacgacatgcactgggtccgccaggctccaggcaaggggctggagtgggtggcatttatatcacatgatggaagtaaaacatactatgcagagtccgtgaagggccgattcaccatctccagagacaattccaagaacacactgtttctgcacatgaaaagcctgagagctgaggacacggctgtttattactgtgcgaacttaatcacggaggacgaacggtaacccccg

SEQ ID NO: 466015 - DNA, 514 bp, Homo sapiens
  misc_feature: HEFZJCU01AXEAP.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctggggccagggaaccctggtcaccgtctcctcagcctccaccaagggcccatcggtcttcccctcggcaccctcctccaagagcacctctcgggggcacagcggccctgggctgcctggtcaaggactacttccgtactacg

SEQ ID NO: 466016 - DNA, 509 bp, Homo sapiens
  misc_feature: HEFZJCU01EZE74.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggcccacctattacttgtgcgcgacatgactacggctcaattctaggggccagggacg

SEQ ID NO: 466017 - DNA, 407 bp, Homo sapiens
  misc_feature: HEFZJCU01C4XWK.49.61.F06.1.454.heavy.3.raw
agtcgagagacacgaccggtgctcgatttagctacgctctaagggaaagggctggagtggctttcatatatcagcagtagtggtagcaccatcttctacgcagactctgtgaagggccgattcaccatttcccgggacaacgccaagaagtcactatctctgcacatgatcagcctgagagccgaggacacggccatgtatttctgtgcgagagcccctcacggtggtgggactgtaccttattacttctacgctatggacgtctggggccaagggaccacggtcaccgtctcctcaccctccaccaagggcccatcggtcttccccctggcaccctcctccaagagcacctctgggggcacagcggccctgggctgcctggtcaaggactacttcctctctcgact

SEQ ID NO: 466018 - DNA, 513 bp, Homo sapiens
  misc_feature: HEFZJCU01B7H2B.40.10.A10.1.454.heavy.3.raw
tctagcgactcacgaccggtgctcgatttagcgtcgatctcaggggggtctcagagaggagccttagccctggactccaaggcctttccacttggtgatcagcactgagcacagaggactcaccatggaattggggctgagctgggttttccttgttgctattttagaaggtgtccagtgtgaggagcagctggtggagtctgggggaggcttggtccagcctggggggtccctgagactctcctgtgttgcctctgggttcacatttcgtaacaattggatgacctgggtccgccaggctccagggaaggggctggagtgggtggccaatataaaccgagatggaaataagatatactatgtggactctgttaagggccgattcaccatctccagagacaacgccaagagttcactgtttctgcaaatgagcagcctgagagccggaggacacgggctctatattactgtacgagagtatttcacgcccctacccaaagtcggaaattatta

SEQ ID NO: 466019 - DNA, 507 bp, Homo sapiens
  misc_feature: HEFZJCU01CKN3U.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctggccaccctcctccaagagcacctctgggggcacagcggccctgggctgcctggtcaaggactacttccgagtagtaca

SEQ ID NO: 466020 - DNA, 537 bp, Homo sapiens
  misc_feature: HEFZJCU01EV1O7.52.73.G07.1.454.heavy.3.raw
cgcagtacgacacgaccggtgctcgatttagctctacgctcagggggtgctttccgagagtcatggacctcctgcacaagaacatgaaacacctgtggttcttcctcctcctggtggcagctcccagatgggtcctgtcccaggtgcacctacaacagtggggcgcaggactgttgaagccttcggagaccctgtccctcacctgcgctgtcgatggtgggtccttcagtggtcgctactggacctggatccgccagcccccagggaaggggctggagtggattggggaaatcaatcatactggaagcattaactataacccgtcccttaagagtcgagtcaccatatcagtcgacacgtccaagaaccaattctccctgaaggtgaggtctgttaccgccgcggacacggctgtctattactgtgcgaaaggccctcacgatgaaaactacgccctggcgctatggacgtctggggccaagggaccacggtcaccgtctcctcagcctccaccaagggcccatcggtcttcccctc

SEQ ID NO: 466021 - DNA, 534 bp, Homo sapiens
  misc_feature: HEFZJCU01DMZK3.52.27.C05.1.454.heavy.3.raw
cgcagtacgacacgaccggtgctcgatttagacgcgatcgaagggtttgggctgagctgggttttccttgttgctattttaaaaggtgtccagtgtggagtgcaggtggtggagtctgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttctggggccagggaacccgggtcaccgtctcctcagcctccaccaagggcccatcggtcttcccctggcaccctcctccaagagcacctctgggggcacagcggccctggctgccg

SEQ ID NO: 466022 - DNA, 519 bp, Homo sapiens
  misc_feature: HEFZJCU01CKQDM.11.13.B02.1.454.heavy.3.raw
  modified_base (257)..(257): a, c, t, g, unknown or other
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacngtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccccgtggccgccctgcctccgaggagcacctccgagagcacagcggccgtgggctc

SEQ ID NO: 466023 - DNA, 533 bp, Homo sapiens
  misc_feature: HEFZJCU01DGVJB.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagccacccggggaagggcctggagtggattggatacatctattactttgggagcacctactacaacccgtccctcaagagtcgagtaacgatctcagtgacacgtctaacaatcacctctccctgaggctgagctctgtgacagccgcggacacgggcgtttattactgtgcggagagggacggacgtacggtgactacgtgggggttcaccccgtggggccaggggaaccctggtccaccgtctccgtcagcctccaaccg

SEQ ID NO: 466024 - DNA, 487 bp, Homo sapiens
  misc_feature: HEFZJCU01AY9T7.40.17.B06.1.454.heavy.3.raw
tctagcgactcacgaccggtgctcgatttagtcgatagtgaagggggcagagcctgctgaattctggctgactagggcagtcaccagagctccagacaatgtctgtctccttcctcatcttcctgcccgtgctgggcctcccatggggtgtcctgtcacaggtacagctgcagcagtcaggtccaggactggtgaagccctcgcagaccctctcactcacctgtgccatctccggggacagtgtctctggtaatagtgttgcttggaactggatcaggcagtccccatggagaggccttgagtggctgggaaggacatcctacaggtccgacaggtccgagtggttaaatgaatttgcagtttttgtggaaagtcgaataaccatcaatgcagacacatccaagaaccagttctccctgcacctaactctatgactcccgaggacgcggctgtttattactgtgcaagaggacgaattgcatactat

SEQ ID NO: 466025 - DNA, 518 bp, Homo sapiens
  misc_feature: HEFZJCU01D9O0F.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctcgtgggggcacagcggccctggctgcctggtcaaggactacttccagacgtatca

SEQ ID NO: 466026 - DNA, 481 bp, Homo sapiens
  misc_feature: HEFZJCU01A619D.19.71.G05.1.454.heavy.3.raw
tactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatatttactgtggaagaggccccataga

SEQ ID NO: 466027 - DNA, 503 bp, Homo sapiens
  misc_feature: HEFZJCU01DYLKM.17.10.A10.1.454.heavy.3.raw
  modified_base (462)..(462): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacgggacacccccacgaacacagtctacatgcaactgacgagcctgagagctgacgacacggccgtctattactgtgcgaagaatgttttcngtcatcgtacaatttgataggctctatggactggacttctc

SEQ ID NO: 466028 - DNA, 510 bp, Homo sapiens
  misc_feature: HEFZJCU01AQJNM.49.35.D02.1.454.heavy.3.raw
agtcgagagacacgaccggtgctcgatttagcacacgatagttgggtttggggggaagaggaagactgacggtcctcccaggagttcaggtgctgggcaccgtgggcatgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattcccaagaacacactatatcttcaaatgaacactctgagacgtgaggacacggctgtctattactgtgcgactgagatgtcttattacgatgccagtgctttagtaccgttcgacccctggggccgagggagccctggtcaccgtctcctcagcttccaccaggccatcggtcttcccctgcgcctgctccaggagcacc

SEQ ID NO: 466029 - DNA, 513 bp, Homo sapiens
  misc_feature: HEFZJCU01EJXBX.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagacgtcccacgacgtccggtgacgccctacggccaggccggcctttgactttcgtc

SEQ ID NO: 466030 - DNA, 503 bp, Homo sapiens; identical to SEQ ID NO: 445995
  misc_feature: HEFZJCU01AHBGE.17.25.C03.1.454.heavy.3.raw

SEQ ID NO: 466031 - DNA, 500 bp, Homo sapiens
  misc_feature: HEFZJCU01EX6K9.47.55.E11.1.454.heavy.3.raw
agctcacgtacacgaccggtgctcgatttagcactcgcacgttgggtttgggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctgggg

SEQ ID NO: 466032 - DNA, 516 bp, Homo sapiens
  misc_feature: HEFZJCU01AX0YK.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattgggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaagggaggggggaaccaggcgggagtccaagtactccttgacgtcgtgggcc

SEQ ID NO: 466033 - DNA, 521 bp, Homo sapiens
  misc_feature: HEFZJCU01CUZNB.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaacccgtggtcgccggtctcctcagcctccaccaagggcccatcggtcttcccctggccaccctcctccaagagcacctctgggggcacagcggccctgggctgcctggtcaaggactacttccagacgtatca

SEQ ID NO: 466034 - DNA, 501 bp, Homo sapiens; identical to SEQ ID NO: 457262
  misc_feature: HEFZJCU01D3W3O.12.38.D05.1.454.heavy.3.raw

SEQ ID NO: 466035 - DNA, 512 bp, Homo sapiens
  misc_feature: HEFZJCU01AYAEX.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccagggaaggggctggagtgggtggccaacataaacaaagacggaagtcaagaaaactatgtgactctgtgaacggccgattcaccatctccagagacaacgccaagaattcactgtatttgcaaatgaacagcctgagaggcgaggacacggccgtgtatttattgtgcgcgagatgatagtagactctacagtagcaggtggta

SEQ ID NO: 466036 - DNA, 379 bp, Homo sapiens; identical to SEQ ID NO: 444450
  misc_feature: HEFZJCU01CFXWB.47.77.G11.1.454.heavy.3.raw

SEQ ID NO: 466037 - DNA, 503 bp, Homo sapiens
  misc_feature: HEFZJCU01D6FA8.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaagggacaat

SEQ ID NO: 466038 - DNA, 398 bp, Homo sapiens; identical to SEQ ID NO: 444524
  misc_feature: HEFZJCU01D7U90.7.60.F05.1.454.heavy.3.raw

SEQ ID NO: 466039 - DNA, 525 bp, Homo sapiens; identical to SEQ ID NO: 447753
  misc_feature: HEFZJCU01ARX5S.16.27.C05.1.454.heavy.3.raw

SEQ ID NO: 466040 - DNA, 487 bp, Homo sapiens; identical to SEQ ID NO: 447190
  misc_feature: HEFZJCU01EUKVC.3.48.E04.1.454.heavy.3.raw

SEQ ID NO: 466041 - DNA, 503 bp, Homo sapiens
  misc_feature: HEFZJCU01DK78X.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaagagcctgacatctgacgacacggccgtctattactgtgcgagagtcccacgatccggtgagcctacggcagcggcctttgacttctc

SEQ ID NO: 466042 - DNA, 505 bp, Homo sapiens
  misc_feature: HEFZJCU01DI5BD.49.53.E09.1.454.heavy.3.raw
agtcgagagacacgaccggtgctcgatttagagagagtgtgttgggtttggggacccaacaaccacatccctcctcagaagcccccagagcacaacgcctcaccatggactggacctggaggatcctctttttggtggcagcagccacaggtgcccactcccaggtccaacttgtgcagtctggggctgagttgaagaagcctggggcctcagtgaaggtttcctgcacggtttctggataccccctcagcagtcatgctatgcattgggtgcgccaggcccccggacaaaggtttgagtggatgggatggatcaccgctggcaatggtgacacaaaatattcacaaaagttccagggcagagtcaccatttacagggacacatctgcgagttcaggctacatggaactgagcggcctgagatatgaggacacggctatttattactgtgcgagagggaaatgggatattgtgtcagctccaggtgcccagccggcccctacttg

SEQ ID NO: 466043 - DNA, 520 bp, Homo sapiens
  misc_feature: HEFZJCU01BXKYE.48.65.F10.1.454.heavy.3.raw
  modified_base (514)..(514): a, c, t, g, unknown or other
agtatacatacacgaccggtgctcgatttagctacgctctaagggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctttctatggtgggtccttcagtggttactactggagctggatccgccagcccccagggaaggggctggagtggattggggaaatcaatcatagtggaagcaccaactacaacccgtccctcaggagtcgagtcaccatatcagtagacacgtccaagaaccagttctccctgaagctgagctctgtgaccgccgcggacacggctgtgtattactgtgcgagagcggatattgtagtagtaccagctgctatttttgtccggtggttcgtaccctgggccagggaaccctggtcaccgtctcctcngcctcc

SEQ ID NO: 466044 - DNA, 520 bp, Homo sapiens
  misc_feature: HEFZJCU01D85IL.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctggggggaggcttggtccagcctggagggtccctaagactctcctgtgcagcctctggactcaccttcacgctcaatggccactacgtggactgggtccgccaggctccagggaagggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctatttattgtgtcatagaccttaggatacaacgacggtggtacctggtattc

SEQ ID NO: 466045 - DNA, 524 bp, Homo sapiens
  misc_feature: HEFZJCU01B07LN.52.82.H05.1.454.heavy.3.raw
cgcagtacgacacgaccggtgctcgatttagtcgagctctctcgcgggggggagacgagcccagcactggaagtcgccggtgtttccattcggtgatcatcactgaacacagaggactcaccatggagtttgggctgagctgggttttcctcgttgctcttttaagaggtgtccagtgtcaggtacaactggtggagtctgggggaggcgtggtccagcctgggaggtccctgagactctcctgtgcagcctctggattcaccttcagtacctatagtatacactgggtccgccaggctcctggcaagggactggagtgggtggcatctatatcaaatgatggaaacaataaccattctacagactccgtaaagggccgattcaccatctccagagacaattccaagaacacgtgtctctacaaatagaacagttagtagacttgaggacgacgcgtgtatattacttagtggtcgcgaggggaagttacgtagttattagacacgccctccgaaggaccacgt

SEQ ID NO: 466046 - DNA, 526 bp, Homo sapiens
  misc_feature: HEFZJCU01B0UZ2.48.26.C04.1.454.heavy.3.raw
agtatacatacacgaccggtgctcgatttagtctagcgactttgggtttggggggaagaggaagactgacggtccccccaggagttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagaagggtttactatggttcggggagtctccgacccagcaactggttcgaccctggggccagggaaccctggtcaccgtctcctcagcctccaccaggcccatcggtcttcccctggcaccctcctccaagacgcacctctggggggcacgac

SEQ ID NO: 466047 - DNA, 398 bp, Homo sapiens; identical to SEQ ID NO: 444524
  misc_feature: HEFZJCU01DSHOV.7.60.F05.1.454.heavy.3.raw

SEQ ID NO: 466048 - DNA, 505 bp, Homo sapiens
  misc_feature: HEFZJCU01ATVO6.48.53.E09.1.454.heavy.3.raw
agtatacatacacgaccggtgctcgatttagagagagtgtgttgggtttggggatgctttctgagagtcatggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactgggcctggatccgccagccccccgggaagggactggaatggattgggagtatctattatacagggagcacctactacaacccgtccctcaagagtcgagtcaccatctccgcagacacgtccaagaaccagttctccctgaggctgagctctgtgaccgccgcagacacggctgtctattactgtgcgagaagtgggtcgtggcagtggctggtacgtggctctcagtggttcgacccgtggggcccagggg

SEQ ID NO: 466049 - DNA, 327 bp, Homo sapiens; identical to SEQ ID NO: 444439
  misc_feature: HEFZJCU01EBCEI.40.20.B09.1.454.heavy.3.raw

SEQ ID NO: 466050 - DNA, 553 bp, Homo sapiens
  misc_feature: HEFZJCU01DC68T.48.27.C05.1.454.heavy.3.raw
agtatacatacacgaccggtgctcgatttagacgcgatcgaagggtttggggatactttctgagagtcctggacctcctgtgcaagaacatgaaacacctgtggttcttcctcctcctggtggcaactcccagatgggtcctgtcccaggtgcagctgcaggagtcgggcccagggctggtgaagccttcggagaccctgtccctcacctgcagtgtctctgatgcctccgtcagcaacgaaattattgttggacctggatccggcaggccccagggaaggcgccggagtggattggatataccggttctcgtcctgcgtacaccaatgacaatcccccctcaggagccgaatctccatatcactggacacgtccaagaaccggttctccctgaccctgaggtctgtgaccgctgcggacacggccgtctattactgtgcgaggattccccttggacacccattttcgggttacttttgaacttattgggggccaggggagccctggtccacccgtctccctcacgcctccaccaacggggccccagtcggtt

SEQ ID NO: 466051 - DNA, 502 bp, Homo sapiens
  misc_feature: HEFZJCU01C2M7M.13.12.B01.1.454.heavy.3.raw
tcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaagggccgattcgccatctccagagacaattccaggaacacgctgtacctggagatggacggcctgagacctgacgacacggcaatttattactgtgcgagggtttatgtgttggaacgtggtacaccggaaactggttcgacccctggggccagggaaccctggtcgtcgtctcgtctgcctccaccaagggcccatcggtcttcccctggcgccctgctccaggagcacctccgagacgcacagcggcccgtgggctgcctggtcaaggactacttccgtactacgacg

SEQ ID NO: 466052 - DNA, 407 bp, Homo sapiens; identical to SEQ ID NO: 445632
  misc_feature: HEFZJCU01C1L63.11.67.G01.1.454.heavy.3.raw

SEQ ID NO: 466053 - DNA, 500 bp, Homo sapiens
  misc_feature: HEFZJCU01AFGVS.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacatttgataggctctatggactggacttctc

SEQ ID NO: 466054 - DNA, 521 bp, Homo sapiens
  misc_feature: HEFZJCU01DD1RK.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccaataaacacagcctacatggagttgaggagcctgacatctgacgacacgggcctctattactgtgcgagacggtcccacggatccgggtgacgccctaacgggccagggccggccttttggacctttcgtc

SEQ ID NO: 466055 - DNA, 489 bp, Homo sapiens
  misc_feature: HEFZJCU01CNW1S.19.53.E09.1.454.heavy.3.raw
tactctcgtgcacgaccggtgctcgatttagagagagtgtgttgggtttggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagcggccctgggctgcctggtcaaggactacttccacgagagta

SEQ ID NO: 466056 - DNA, 508 bp, Homo sapiens
  misc_feature: HEFZJCU01APEUK.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtgggttgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaaagtgacgtggtagttccggggggacacatgactaccg

SEQ ID NO: 466057 - DNA, 523 bp, Homo sapiens
  misc_feature: HEFZJCU01DWO2S.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactcccgaccccgtgaagggccgattaaccatctccagagacgattccgagaacacggtgtatcttcaaatgaacaacctgagagccgacgacacggccgtttattactgtgcgagagattcgagtggttcggggacctcaccctggttctacttcgatctctggggcc

SEQ ID NO: 466058 - DNA, 499 bp, Homo sapiens
  misc_feature: HEFZJCU01D36DC.47.81.H04.1.454.heavy.3.raw
agctcacgtacacgaccggtgctcgatttagtagtgtagattcgcggggagctctgggagtggagccccagccttgggattcccaagagtttgtattcagtgatcaggactgaacacacaggactcaccatggagttggggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtg

SEQ ID NO: 466059 - DNA, 530 bp, Homo sapiens
  misc_feature: HEFZJCU01EJCZO.51.26.C04.1.454.heavy.3.raw
cgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacgggagttacttcctccgcaacggtatggacgtctggggccaagggaccacggtcaccgtctccttagcctccaccaaggcccatcggtcttcccctggcaccctcctccaagagcacctctc

SEQ ID NO: 466060 - DNA, 506 bp, Homo sapiens; identical to SEQ ID NO: 445682
  misc_feature: HEFZJCU01DWZPD.48.44.D11.1.454.heavy.3.raw

SEQ ID NO: 466061 - DNA, 471 bp, Homo sapiens; identical to SEQ ID NO: 444988
  misc_feature: HEFZJCU01A0KIH.48.1.A01.1.454.heavy.3.raw

SEQ ID NO: 466062 - DNA, 379 bp, Homo sapiens; identical to SEQ ID NO: 444450
  misc_feature: HEFZJCU01CLEGA.47.77.G11.1.454.heavy.3.raw

SEQ ID NO: 466063 - DNA, 499 bp, Homo sapiens
  misc_feature: HEFZJCU01EW6T6.12.2.A02.1.454.heavy.3.raw
atacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgagtggatgggatggatcagcgcttacaatggtaacacagactatgcacagaagttccaggacagagtcaccatgaccacagacacatccacgagcacagcctacatggagctgaggagcctgagatctgacgacacggccgtgtattactgtgcgagaggttttagtgtatacttattgtagtggtggtacctgcttacgtttttc

SEQ ID NO: 466064 - DNA, 521 bp, Homo sapiens
  misc_feature: HEFZJCU01CWUT2.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctggggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacgggccgtctattattgtgtcatagaacctaggatacaacgacggtggtacctggtattc

SEQ ID NO: 466065 - DNA, 491 bp, Homo sapiens; identical to SEQ ID NO: 447981
  misc_feature: HEFZJCU01CS3I8.47.85.H08.1.454.heavy.3.raw

SEQ ID NO: 466066 - DNA, 542 bp, Homo sapiens
  misc_feature: HEFZJCU01ECL53.13.40.D07.1.454.heavy.3.raw
tcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccagggggggcctggagtggcttggaagcatctctcaaagcgggacgaccgactataacccgtcttttaggagtcgagtctcgatttcaatagacaggtctaagacacaattctccctgagggtgacctctatgtcggccgcggacgcggccgtctattactgtgcgcgaggatctccgtcggaacacttcgtgacaaggcaaaacgtccgaagtcgttatcactttgactcctgggccaggggaaccctggtcagcgtctcttcagcctccaccaagggcccatccggtcttcccctggccaccctcctccaagagcacctctcgggggcacagcggccctcgggctggcct

SEQ ID NO: 466067 - DNA, 526 bp, Homo sapiens
  misc_feature: HEFZJCU01B2BAH.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctgggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggagtacagtggcagctccaagtactactttgacttctggggccagggaaccctggtcaccgtctcctcagcctccaccaagggcccatcggtcttcccctggcgccctgctccaggagcacctccgaga

SEQ ID NO: 466068 - DNA, 508 bp, Homo sapiens
  misc_feature: HEFZJCU01B2P4W.4.81.H04.1.454.heavy.3.raw
agcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtctgggggaggcctggtcaaacctgggggtccctgagactctcgtgtgtagtctctgaattcatcttcagggactttgacatgaattgggtccgccaggctccagggaaggggctggagtgggtctcatccatcagttccagtactcgttacatatactacgcagactcagtgagggccgattcaccatctccagagacaacgccaagaactcagtgtttctgcaaatgaacagcctgagagtcgaggactcggctgtctactactgtgcgaggaataagggagctaccctacgatttggacacg

SEQ ID NO: 466069 - DNA, 395 bp, Homo sapiens; identical to SEQ ID NO: 444494
  misc_feature: HEFZJCU01BGRVA.47.46.E02.1.454.heavy.3.raw

SEQ ID NO: 466070 - DNA, 500 bp, Homo sapiens
  misc_feature: HEFZJCU01B92P8.11.57.F02.1.454.heavy.3.raw
cgagagataccacgaccggtgctcgatttagctcgatatagttgggtttgggggctctcagataggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccagccgggggggtccctgagactctcctgtctagtctctggattcgccttcagtgactatgccatgaagtgggtccgccaggctccaggtaaggggctggaatgggatttcatacattagcagtagtggtgcgaccatatactacgcagactctgtgaagggccgattcatcatctccagagacaatggcaacaactcactgtatctggaaatcaacagcctgagagtcgagggacacggctgtatattattgtgcgagagccccctacggtgacg

SEQ ID NO: 466071 - DNA, 499 bp, Homo sapiens
  misc_feature: HEFZJCU01A6CPQ.47.56.F01.1.454.heavy.3.raw
agctcacgtacacgaccggtgctcgatttagcagacgtctgaacacacaaagggggccccagccctgggattcccagctgtttctgcttgctgatcaggactgcacacagagaactcaccatggagtttgggctgagctgggttttccttgttgctattttaaaaggtgtccagtgtgaggtgcaactggtggagtccgggggaggcttaattcagcctggggggtccctgagactctcctgtgcagcctctggattcaccttcagtagttactggatgcactgggtccgccaagctccagggaaggactggtgtgggtctcacgtattaatcctgatggaagtcgcacaaactacgcggactccgtgagggaccgattcaccatctccagagacaacgccaagaacacgctgtatctgcaaatgcacagtctgagagccgacgatgcggctgtatatttctgtgcaagagatcaactggtgggaccgacttttatttc

SEQ ID NO: 466072 - DNA, 486 bp, Homo sapiens
  misc_feature: HEFZJCU01A0S8A.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctcggcgccctgctccaggagcacctccgagagcacagcggcccgtcgggctgcctggtcaaggactacttcccactactatg

SEQ ID NO: 466073 - DNA, 494 bp, Homo sapiens
  misc_feature: HEFZJCU01DDFUF.13.85.H08.1.454.heavy.3.raw
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtcttgagtggatgggactaatcactcccaatggtgatgggactgcctacgcacagaagtttcagggcagagtcaccatgaccagggacacgtccacgagaacagacatttggagttgagcagcctgagatctgacgacacggccgtttattactgtgcgcgagataatagtcacaactggaacggcgttttggggt

SEQ ID NO: 466074 - DNA, 524 bp, Homo sapiens
  misc_feature: HEFZJCU01CNW95.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcttttacacctcccttgacttctgggccatggaacccggtc

SEQ ID NO: 466075 - DNA, 482 bp, Homo sapiens; identical to SEQ ID NO: 444503
  misc_feature: HEFZJCU01DOHSQ.7.10.A10.1.454.heavy.3.raw

SEQ ID NO: 466076 - DNA, 525 bp, Homo sapiens
  misc_feature: HEFZJCU01EXD7C.10.85.H08.1.454.heavy.3.raw
catagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaaacgatgtgagagtcgaggacacggctgtatatttctgtgcgaggggacgccggctatggttcggacctcgtggggcccaggggaacccctggtccg

SEQ ID NO: 466077 - DNA, 498 bp, Homo sapiens
  misc_feature: HEFZJCU01BFG33.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagatttactatagaggtgactacggggcgttcg

SEQ ID NO: 466078 - DNA, 523 bp, Homo sapiens; identical to SEQ ID NO: 446270
  misc_feature: HEFZJCU01E0WMT.12.40.D07.1.454.heavy.3.raw

SEQ ID NO: 466079 - DNA, 484 bp, Homo sapiens; identical to SEQ ID NO: 445876
  misc_feature: HEFZJCU01EYO3N.8.39.D06.1.454.heavy.3.raw

SEQ ID NO: 466080 - DNA, 529 bp, Homo sapiens
  misc_feature: HEFZJCU01EWAYA.12.86.H09.1.454.heavy.3.raw
  modified_base (380)..(380): a, c, t, g, unknown or other
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttcngtgcgagtcttgatagtagtggttatcctgaatactggggccagggaaccctggtgaccgtctcctcagcctccaccaagggcccatcggtcttcccctggcgccctgctccaggagcacctccgagagcacagcggcccgtgggtccg
